(12) United States Patent
Carulli et al.

(10) Patent No.: US 7,151,161 B1
(45) Date of Patent: Dec. 19, 2006

(54) HUMAN GENES OF CHROMOSOME 11Q13.3

(75) Inventors: John P. Carulli, Southboro, MA (US); Randall D. Little, Needham, MA (US); Richard Del Mastro, Norfolk, MA (US); Mark Osborne, Needham, MA (US)

(73) Assignee: Oscient Pharmaceuticals Corporation, Waltham, MA (US)

( * ) Notice: Subject to any disclaimer, the term of this patent is extended or adjusted under 35 U.S.C. 154(b) by 171 days.

(21) Appl. No.: 10/185,047

(22) Filed: Jul. 1, 2002

Related U.S. Application Data

(60) Division of application No. 09/358,001, filed on Jul. 21, 1999, now abandoned, and a continuation-in-part of application No. 09/229,319, filed on Jan. 13, 1999, now abandoned.

(60) Provisional application No. 60/134,103, filed on May 14, 1999, provisional application No. 60/105,511, filed on Oct. 23, 1998, provisional application No. 60/071,449, filed on Jan. 13, 1998.

(51) Int. Cl.
*C07K 14/00* (2006.01)
*C12P 21/06* (2006.01)
*C12N 5/00* (2006.01)
*C12N 15/00* (2006.01)
*C12N 15/63* (2006.01)

(52) U.S. Cl. ............... 530/350; 435/69.1; 435/320.1; 435/325; 435/455; 530/351; 536/23.1; 536/23.5

(58) Field of Classification Search .............. 435/69.1, 435/320.1, 325, 455; 536/23.1, 23.5; 530/350
See application file for complete search history.

(56) References Cited

U.S. PATENT DOCUMENTS 5,691,153 A  11/1997  Recker et al.

FOREIGN PATENT DOCUMENTS

WO  98/39448  9/1998

OTHER PUBLICATIONS

Altier et al Neuropharmacol. 40:1050-1057, 2001.*
ASBMR 18th Annual Meeting, Supplement 1, S661, vol. 11, 1996 (American Society of Bone & Mineral Research, U.S.A.).
Am. J. Hum. Genet., "Linkage of a Gene Causing High Bone Mass to Human Chromosome 11 (11q12-13)" Mark K. Johnson et al., 60:1326-1332, pp. 1326-1332, 1997 (University of Chicago Press, U.S.A.).
Am. J. Hum. Genet., "Fine Mapping of the Diabetes-Susceptibility Locus, IDDM4, on Chromosome 11q13" Yusuke Nakagawa et al., 63:547-556, pp. 547-556, 1998 (University of Chicago Press, U.S. A.).
Proc. Natl. Acad.. Sci. USA, "Ion Channel Genes and Human Neurological Disease: Recent Progress, Prospects, and Challenges", Edward C. Cooper et al., vol. 96, pp. 4759-4766, Apr. 1999 (National Academy of Science, U.S.A.).
Journal of Bone and Mineral Research, "Linkage of a QTL Contributing to Normal Variation in Bone Mineral Density to Chromosome 11q12-13", D.L. Koller et al., vol. 12, No. 12, pp. 1903-1908, 1998, (American Society of Bone & Mineral Research, U.S.A.).

* cited by examiner

*Primary Examiner*—Sumesh Kaushal
(74) *Attorney, Agent, or Firm*—Medlen & Carroll, LLP

(57) ABSTRACT

This invention relates to isolated nucleic acids comprising novel genes of a 20 cM region of human chromosome 11q13.3 and the proteins encoded by these genes. Expression vectors and host cells containing these genes or fragments thereof, as well as antibodies to the proteins encoded by these nucleic acids are also included herein.

3 Claims, 86 Drawing Sheets

FIG. 1C

| FROM FIG 1C | 9020 -0.15 | 9021 5.00 | 9022 -.034 | 9023 |
|---|---|---|---|---|
| | 1\|7 | 1\|7 | ?:? | 1\|5 |
| | 7\|7 | 7\|5 | ?:? | 5\|7 |
| | 6\|5 | 6\|3 | ?:? | 5\|6 |
| | 4\|1 | 3\|8 | ?:? | 2\|3 |
| | 4\|7 | 4\|3 | ?:? | 6\|4 |
| | 3\|2 | 4\|1 | ?:? | 2\|4 |
| | 1\|3 | 3\|4 | ?:? | 6\|4 |
| | ?4/2? | 2\|2 | ?:? | ?3/1? |
| | 6\|7 | 2\|4 | ?:? | 2\|6 |
| | 2\|5 | 4\|3 | ?:? | 2\|2 |
| | 5\|8 | 1\|7 | ?:? | 4\|5 |
| | | | | 1\|8 |

| FROM FIG 1C | 9019 2.36 | 9018 2.91 |
|---|---|---|
| | 1\|3 | 1\|3 |
| | 3\|?25/7? | ?27/5? |
| | 6\|6 | 6\|3 |
| | 3\|3 | 3\|1 |
| | 5\|4 | 4\|2 |
| | ?22/4? | 4\|2 |
| | 2\|4 | 3\|3 |
| | 1\|3 | 2\|1 |
| | 3\|4 | 2\|2 |
| | 6\|2 | 4\|2 |
| | 8\|3 | 1\|11 |

Zmax7A: 4.9 kb Transcript b200e21-h_971124_Contig2 4645-4543 gcctcccctaccccattacCTGGAGGTGCCCACGACCCGCCGCTAGTTGCGCT
CAGGCGGGAAACGCGCTCACCGACACCATCAGCGAAGCGCCCAAAATGGCGGAC
GTATCAAGCAGGCCTtgagttccccccgcccgccc b200e21-h_971124_Contig2 50454-50306 aatgtaattaaagccacatacccttaaaattatgggaggtacCTCAAACTGAA
GACACAAGGGTATTATATGACCCCTCCATATGGCCGAGGAAGTTCTGTCACTAT
TTGAGCAAGTCACCACATCTCTCTGAGCTTGTTTTCTTATctgtaaatgagagg
tttagacta b200e21-h_971124_Contig3 58771-58921 gcttttttttttcttttacagGAGAGCTTGTTTCATATCCATATCCCACTGTAT
TCCTGCTAATCTGCTAATGCAGTAAATTGGAGGAAAACTGTTACCAGGATAACC
TGTAATGGGCAAGGAGCCACAAAGAAGAAAACATTTCTTTTAATTTTTAAACTT
GGTTTGAAAGgtaagaccattacgattagcagg b200e21-h_971124_Contig3 33374-33560 tgtaaatatcctgttcttctagGTATCCAAATATATCTTGTGAGTTGCTCACTT
CTGATGTCTCCCAGATGAATGATAGACTGGGAGAAGATGAATCCTTGCTAATGA
AATTATATAGCTTCCTCCTAAACGATTCCCCTTTGAATCCACTACTTGCCAGTT
TCTTCAGCAAGGTGCTAAGTATTCTTATCAGCAGAAAACCAGAACAGgtaaata
tgattttccaaaa > b200e21-h_971124_Contig3 30194-30331 tttctgatctgttcttctctagATTGTGGATTTCTTAAAGAAGAAGCATGATTT
TGTAGACCTTATTATAAAGCACATAGGAACTTCTGCTATCATGGATTTGTTGCT
CAGGCTCCTGACGTGTATCGAACCTCCACAGCCCAGGCAAGATGTGCTGAATgt
gagtagaattctgacctg b200e21-h_971124_Contig3 27212-27277 ttctacaatgtgttttacagTGGTTAAATGAGGAGAAAATTATCCAGAGGCTTG
TGGAAATAGTTCATCCATCGCAAGAAGAAGATgtaagttcacttgtgtgact

FIG. 3A b200e21-h_971124_Contig3 24141-24253 attgtacttttttcctttagCGACATTCAAATGCATCACAATCACTTTGTGAAA
TTGTTCGCCTGAGCAGAGACCAGATGTTACAAATTCAGAACAGTACAGAGCCCG
ACCCCCTGCTTGCCACTCTAGAAAgtatgtgtaaaactctgttct b200e21-h_971124_Contig3 19719-19832 attattgatttgtttccctagGCAAGAAATTATAGAGCAGCTTCTATCAAATAT
TTTCCACAAGGAGAAAAATGAGTCAGCCATAGTCAGTGCAATCCAGATATTGCT
GACTTTACTTGAGACACGACGACCAACgtaagcttttcttatatctt b576i10-h_980727_Contig197G 80146-80275 attccttgctttgtttcaagATTTGAAGGCCATATAGAGATCTGCCCACCAGGC
ATGAGCCATTCAGCTTGTTCAGTAAACAAGAGTGTTCTAGAAGCCATCAGAGGA
AGACTTGGATCTTTTCATGAACTCCTGCTGGAGCCACCCAAGgtaggggagcta
tgttaagc b576i10-h_980727_Contig197G 77413-77565 tggaaagcttttctcttcagAAAAGTGTGATGAAGACCACATGGGGTGTGCT
GGATCCTCCTGTGGGGAATACCCGGTTGAATGTCATTAGGTTGATATCCAGCCT
GCTTCAAACCAATACCAGCAGTATAAATGGGGACCTTATGGAGCTGAATAGCAT
TGGAGTCATATTGgtgagattttccctgctcac b576i10-h_980727_Contig197G 74681-74830 catggttttttcttttttgtagAACATGTTCTTCAAGTATACATGGAATAACTTT
TTGCATACACAAGTGGAAATTTGTATTGCACTGATTCTTGCAAGTCCTTTTGAA
AACACAGAAAATGCCACAATTACCGATCAAGACTCCACTGGTGATAATTTGTTA
TTAAAACATgtaagcttatttggtctcgt b576i10-h_980727_Contig197G 73474-73538 attcttttttttttttttcagCTTTTCCAAAAATGTCAATTAATAGAACGAATAC
TTGAAGCCTGGGAAATGAATGAGAAGAAACAgtaagtaaattgttttttga b576i10-h_980727_Contig197G 70353-70468 tgtcctttacctcttgtcagGGCTGAGGGAGGAAGACGGCATGGTTACATGGGA
CACCTAACGAGGATAGCTAACTGTATCGTGCACAGCACTGACAAGGGCCCCAAC
AGTGCATTAGTGCAGCAGCTTATCAAAGgtaagttatttgtgaaattt

FIG. 3B b576i10-h_980727_Contig197G 68534-68619 tttttgcttttctcactctgaagATCTTCCCGACGAAGTCAGGGAACGATGGGA
GACGTTCTGCACAAGCTCCTTAGGAGAAACTAACAAGAGGAACACGGTAGATCT
Agtaggttttacaaggttacatt b576i10-h_980727_Contig197G 61462-61548 ttacatttttatgcatatagGTTACAACCTGCCATATTCATTCATCCAGTGATG
ATGAAATTGACTTTAAAGAAACGGGTTTCTCACAGGATTCTTCTTTGCAGCAAg
tgagtcacgcctaaagcttt b576i10-h_980727_Contig197G 56566-56663 actggtcctggggttgccagGCCTTTTCTGATTATCAGATGCAACAAATGACGT
CCAATTTTATTGACCAGTTTGGCTTCAACGATGACAAGTTTGCACATCAAGATG
ACATTGGCAAgtgagtatgtttttctgttt b576i10-h_980727_Contig197G 53876-53930 tttatttttgttttttttacagTGTTTCTTTTGATCGAGTATCAGACATCAACTTT
ACTCTCAATACAAATGAAAGTgtaagtataaactctgttgtg b576i10-h_980727_Contig197G 52884-53014 ttcctctcatttttatttagGGAAATATTGCCTTGTTTGAAGCATGTTGTAAGG
AAAGAATACAACAGTTTGATGATGGTGGCTCTGATGAGGAAGATATATGGGAGG
AAAAGCACATCGCATTCACACCAGAATCCCAAAGACGATCCAGgtgaaagatag
ttggttata b576i10-h_980727_Contig197G 48371-48492 cttgggtcttgttttttccttagCTCGGGGAGTACAGACAGTGAGGAAAGTACAG
ACTCTGAAGAAGAAGATGGAGCAAAGCAAGACTTGTTTGAACCCAGCAGTGCCA
ACACGGAGGATAAAATGGAGGTGGACCTGAGTGAACgtaagtggattcattctt
ca b576i10-h_980727_Contig197G 44095-44248 aatttctcccctctttttagCACCCAACTGGTCAGCTAACTTTGATGTCCCAAT
GGAAACAACCCACGGTGCTCCATTGGATTCTGTGGGATCTGATGTCTGGAGCAC
AGAGGAGCCGATGCCAACTAAAGAGACGGGCTGGGCTTCTTTTTCAGAGTTCAC
GTCTTCCCTGAGgtgagcgaacatgtgctgtc

FIG. 3C b576i10-h_980727_Contig197G 42620-42726 tgaattttctctttttgaaagCACAAAAGATTCTTTAAGGAGTAATTCTCCAG
TGGAAATGGAAACCAGCACTGAACCCATGGACCCTCTGACTCCCAGTGCGGCTG
CCCTGGCAGTGCAGCCAGAAGgtgcgtgcagagaggcctgg b576i10-h_980727_Contig197G 41097-41247 ccatcagctgtgttcttttcagCGGCAGGCAGTGTGGCCATGGAAGCCAGCTCT
GACGGAGAGGAGGATGCAGAAAGTACAGACAAGGTAACTGAGACAGTGATGAAT
GGCGGCATGAAGGAAACGCTCAGCCTCACTGTAGATGCCAAGACAGAGACTGCG
GTCTTCAAAAGgtaaccaggggtgagatcctac b576i10-h_980727_Contig197G 34566-34685 cctgtcatcctctttactgcagTGAGGAAGGGAAACTGTCTACCTCTCAAGATG
CTGCTTGTAAAGACGCAGAGGAGTGTCCGAGACTGCAGAGGCGAAGTGCGCG
CGCCCAGGCCTCCCAGCAGCAGTCCCGAGCAGAGtaaccacccgcctcctcaa
a b576i10-h_970727_Contig197G 29252-31523 agGACTGGCCAACCAAGCGCACCAGGTGACACTTCAGTGAATGGCCCTGTATGA
CGGGTGACGTCTGCTGCTGCTGACTGAGGACTGCAGACCGCCACCACTCAGGGG
CTCTGGAGGGGTCAGCTGGAGCCCACCAAGCTGTCACTGCTGCACTCACTCTGC
AAGGGATCAGGACCAGCAACCTTTATATTCTAGATTCTAAGACATTGTACAGAG
AAATTCAGAAGTGTAAAAATATTGCACATTGACAAATACCAAGAATTTTTGCGT
ATGTTTATATTGTATTGTTCTAAATAATGGGTAGCCTGTGAAATAAGATCTTGC
CACCCATGTAATAATAGTAGTAATACTATAGTTAAAATGGCTGTAAGAATAGTT
TTATAAAAGTGAATACACAGATCTATTGTATTTGAAACATAACTTTGACAATTA
TTAGTGTGACCAAAGTATTAGGCGGTTTTCATACATTTTTCACCTTGTACAAAA
TTATGAATTCATTTTTCCTCCAGGCCGACAAGGAGTTGTAGAATGAAAATGCCC
TCTAAGTGTTATTTTGGTTGTTCTAACTTACAAAAGTGATTTGAATAAGAAAT
ATTTGGTGTTCTTTTTATAACCAGTTTTTGATTGGTAATTGTTTCTGTATTGT
TTAAAACGGATCAAAAATGTAAGTCTATTGGTAGAGATTAAGTAAAGTATTTAT
TGCTACATCATAGTTGATAAATTGATGTTATCGTAAAGCCATATGTTCTGTTCA
AGTCTTGTTTGCTTGAAATGATTATTCCTACAAGTGAAACACTAGACTATTTGG
AGTGTATATGGCTTGTGTTTTGGGATTTTTTTTTTTTTTTTGGCTTTTGTTT
TTGTTTGTTTTTTTGTTTCATTTGGTAGTTCATCTGCCTTTTAACCCATTCACC
AAAATTTACCTTGTTAACAAGCATCACCAATGAACATTTCAGAGCAATCTGCAT
ATTTAACAGACCTAAAATAAATCCTATTAGGCAAGTCAGTTGAAAATGCTCGTG
CTGCTAATGGAATTAGAGTGCGTTCATTTTACAGGCTAGTATTTTAAAAGTAGA
AATCAAAATCTGGCACCGAAGCATGCTAATTGTTTACTGTACCTTGTGAGGTTT

FIG. 3D

```
TCACTCATAAATTTAAACCAGTGTATTTTTTTAGAACTGGTTTGTGTATATATA
TAGTGATTATGGATACTAATTCAATGTAATTTATAATTTTCTATGTCAATACAA
AAATACATCACAGCCTTCTCAAACAGCTCAAGCAATATATTGTATATTGCCATA
TCGTCTGGTGAAAGGGTTAAATTACTTCACCTCTTGCACTTTTAGATGCAAATC
AGTTTTTCATTTCTGTAATAGAAAATTATTCACGTATTTTTACATCATTTGTTT
TTCCTGACCAGTATTTAAAACCAAAAGGATATTCTGAAAAATGGCCAACAATTT
TTTTAGAAGTAGCATCCCAAGCAGCGTGCCTAAACATTACATTGCATATGGAAA
TAAAAGAATCAAACGTCTAATGCCTTATTATTTCTGATTTCCTTTTTCATTTTA
AGTGGTGTGGAGATTCCAGCACTCCCAGGACAGTGGAGTCAGCAGTAAGCCCTG
GGACAGGTGGCAAGGGTGGGTCCCTTGACCTTTGCACGCCTCCTCAGGAACCCC
CTTTCCCGGGTGAGCCCCTCTCTGAAGAGACTGTCCTTGGGCCTCCTCTGGAAG
CAGCACCCCAGAGGACAGGGCTCCTCCTGCTTGCCTCAGGCCTGCCTGACTTG
AATGGCGTTGGACCTCGGGGATTACTGGTAGATAATATGCTCTGGTCTCGCCTG
GTGGTGAGTTTTGCCAGCCATGGCCAGGGTTTGGCTCCACTGGTGGCACACGTG
GCCTCCGTGGTATGGACCTGGTGGCTTCTCCATCCCACTGTGGCCTCTGTGGTA
TGGACCTGGTGGCTTCTCCATCCTACCCAAGGTAACAGTGTCTTGCTTCATCCC
ACTGACTGCTGGGAGAGAGCCTCTGGGACTTTTCTTTGGGGCATCATTTTGTTT
TGTCTTTCGTAGCAGGGAAAGGATATGACAATGGGGAGGACAGTTCTTTTGGAG
GTTGGAGGGGCCAAGCCAAGGACAGGAGCAAGTGTGCCCTCATTTTGTTTCTAC
TTTTAATTTCTGTGTGTTGGCCATACTGAATTATGAGACTAACAGATGTCTACA
ATACAATACCTGTATTCAAAATAACAAAAATAAAGCCTGATTCTTTGTTTCTAG
aaaaaaaaaaaaa
```

FIG. 3E

Zmax7B:    5.4 kb Transcript b200e21-h_971124_Contig2 4645-4543 gcctcccctaccccattacCTGGAGGTGCCCACGACCCGCCGCTAGTTGCGCT
CAGGCGGGAAACGCGCTCACCGACACCATCAGCGAAGCGCCCAAAATGGCGGAC
GTATCAAGCAGGCCTgagttccccccgcccgccc b200e21-h_971124_Contig2 50432-50306 aatgtaattaaagccacatacCCCTTAAAATTATGGGAGGTACCTCAAACTGAA
GACACAAGGGTATTATATGACCCCTCCATATGGCCGAGGAAGTTCTGTCACTAT
TTGAGCAAGTCACCACATCTCTCTGAGCTTGTTTTCTTATctgtaaatgagagg
tttagacta b200e21-h_971124_Contig3 58771-58921 gctttttttttctttacagGAGAGCTTGTTTCATATCCATATCCCACTGTAT
TCCTGCTAATCTGCTAATGCAGTAAATTGGAGGAAAACTGTTACCAGGATAACC
TGTAATGGGCAAGGAGCCACAAAGAAGAAAACATTTCTTTTAATTTTTAAACTT
GGTTTGAAAGtaagaccattacgattagcagg b200e21-h_971124_Contig3 40523-40755 atactttctgcattttgtttagACCAGCATGTTTTGGAAATTTGATCTTCACTC
ATCATCCCACATAGACACACTTCTAGAAAGAGAAGATGTAACACTGAAGGAGTT
AATGGATGAGGAAGATGTTTACAGGAATGTAAAGCTCAGAACCGCAAACTTAT
AGAGTTTCTGTTAAAAGCAGAATGTCTCGAAGATTTAGTCTCATTCATTATAGA
AGAACCACCTCAAGACATGGATGAAAGATCAGATACAAgtaagacaattcaat
cttctctg b200e21-h_971124_Contig3 33374-33560 tgtaaatatcctgttcttctagGTATCCAAATATATCTTGTGAGTTGCTCACTT
CTGATGTCTCCCAGATGAATGATAGACTGGGAGAAGATGAATCCTTGCTAATGA
AATTATATAGCTTCCTCCTAAACGATTCCCCTTTGAATCCACTACTTGCCAGTT
TCTTCAGCAAGGTGCTAAGTATTCTTATCAGCAGAAAACCAGAACAGgtaaata
tgattttccaaaa > b200e21-h_971124_Contig3 30194-30331 tttctgatctgttcttctctagATTGTGGATTTCTTAAAGAAGAAGCATGATTT
TGTAGACCTTATTATAAAGCACATAGGAACTTCTGCTATCATGGATTTGTTGCT
CAGGCTCCTGACGTGTATCGAACCTCCACAGCCCAGGCAAGATGTGCTGAATgt
gagtagaattctgacctg

FIG. 4A b200e21-h_971124_Contig3 27212-27277 ttctacaatgtgttttacagTGGTTAAATGAGGAGAAAATTATCCAGAGGCTTG
TGGAAATAGTTCATCCATCGCAAGAAGAAGATgtaagttcacttgtgtgact b200e21-h_971124_Contig3 24141-24253 attgtactttttttcctttagCGACATTCAAATGCATCACAATCACTTTGTGAAA
TTGTTCGCCTGAGCAGAGACCAGATGTTACAAATTCAGAACAGTACAGAGCCCG
ACCCCCTGCTTGCCACTCTAGAAAgtatgtgtaaaactctgttct b200e21-h_971124_Contig3 19719-19832 attattgatttgtttccctagGCAAGAAATTATAGAGCAGCTTCTATCAAATAT
TTTCCACAAGGAGAAAAATGAGTCAGCCATAGTCAGTGCAATCCAGATATTGCT
GACTTTACTTGAGACACGACGACCAACgtaagcttttcttatatctt b576i10-h_980727_Contig197G 80146-80275 attccttgctttgttttcaagATTTGAAGGCCATATAGAGATCTGCCCACCAGGC
ATGAGCCATTCAGCTTGTTCAGTAAACAAGAGTGTTCTAGAAGCCATCAGAGGA
AGACTTGGATCTTTTCATGAACTCCTGCTGGAGCCACCCAAGgtaggggagcta
tgttaagc b576i10-h_980727_Contig197G 77413-77565 tggaaagcttttttcttcttcagAAAAGTGTGATGAAGACCACATGGGGTGTGCT
GGATCCTCCTGTGGGGAATACCCGGTTGAATGTCATTAGGTTGATATCCAGCCT
GCTTCAAACCAATACCAGCAGTATAAATGGGGACCTTATGGAGCTGAATAGCAT
TGGAGTCATATTGgtgagatttccctgctcac b576i10-h_980727_Contig197G 74681-74830 catggttttctttttttgtagAACATGTTCTTCAAGTATACATGGAATAACTTT
TTGCATACACAAGTGGAAATTTGTATTGCACTGATTCTTGCAAGTCCTTTTGAA
AACACAGAAAATGCCACAATTACCGATCAAGACTCCACTGGTGATAATTTGTTA
TTAAACATgtaagcttatttggtctcgt b576i10-h_980727_Contig197G 73474-73538 attcttttttttttttttcagCTTTTCCAAAAATGTCAATTAATAGAACGAATAC
TTGAAGCCTGGGAAATGAATGAGAAGAAACAgtaagtaaattgttttttga

FIG.4B b576i10-h_980727_Contig197G 70353-70468 tgtcctttacctcttgtcagGGCTGAGGGAGGAAGACGGCATGGTTACATGGGA
CACCTAACGAGG

ATAGCTAACTGTATCGTGCACAGCACTGACAAGGGCCCCAACAGTGCATTAGTG
CAGCAGCTTATCAAAGtaagttatttgtgaaattt b576i10-h_980727_Contig197G 68534-68619 tttttgcttttctcactctgaagATCTTCCCGACGAAGTCAGGGAACGATGGGA
GACGTTCTGCACAAGCTCCTTAGGAGAAACTAACAAGAGGAACACGGTAGATCT
Agtaggttttacaaggttacatt b576i10-h_980727_Contig197G 56566-56663 actggtcctggggttgccagGCCTTTTCTGATTATCAGATGCAACAAATGACGT
CCAATTTTATTGACCAGTTTGGCTTCAACGATGAGAAGTTTGCAGATCAAGATG
ACATTGGCAAgtgagtatgtttttctgttt b576i10-h_980727_Contig197G 53876-53930 tttattttgttttttttacagTGTTTCTTTTGATCGAGTATCAGACATCAACTTT
ACTCTCAATACAAATGAAAGtaagtataaactctgttgtg b576i10-h_980727_Contig197G 52884-53014 ttcctctcattttatttagGGAAATATTGCCTTGTTTGAAGCATGTTGTAAGG
AAAGAATACAACAGTTTGATGATGGTGGCTCTGATGAGGAAGATATATGGGAGG
AAAAGCACATCGCATTCACACCAGAATCCCAAAGACGATCCAGgtgaaagatag
ttggttata b576i10-h_980727_Contig197G 48371-48492 cttgggtcttgttttccttagCTCGGGGAGTACAGACAGTGAGGAAAGTACAG
ACTCTGAAGAAGAAGATGGAGCAAAGCAAGACTTGTTTGAACCCAGCAGTGCCA
ACACGGAGGATAAAATGGAGGTGGACCTGAGTGAACgtaagtggattcattctt
ca b576i10-h_980727_Contig197G 44095-44248 aatttctcccctcttttagCACCCAACTGGTCAGCTAACTTTGATGTCCCAAT
GGAAACAACCCACGGTGCTCCATTGGATTCTGTGGATCTGATGTCTGGAGCAC
AGAGGAGCCGATGCCAACTAAAGAGACGGGCTGGGCTTCTTTTTCAGAGTTCAC
GTCTTCCCTGAGgtgagcgaacatgtgctgtc

FIG.4C b576i10-h_980727_Contig197G 42620-42726 tgaatttttctctttttttgaaagCACAAAAGATTCTTTAAGGAGTAATTCTCCAG
TGGAAATGGAAACCAGCACTGAACCCATGGACCCTCTGACTCCCAGTGCGGCTG
CCCTGGCAGTGCAGCCAGAAGgtgcgtgcagagaggcctgg b576i10-h_980727_Contig197G 41097-41247 ccatcagctgtgttcttttcagCGGCAGGCAGTGTGGCCATGGAAGCCAGCTCT
GACGGAGAGGAGGATGCAGAAAGTACAGACAAGGTAACTGAGACAGTGATGAAT
GGCGGCATGAAGGAAACGCTCAGCCTCACTGTAGATGCCAAGACAGAGACTGCG
GTCTTCAAAAGgtaaccagggtgagatcctac b576i10-h_980727_Contig197G 34961-35116 ctttaactaaagactcattccttcaaacagGTTCTTTGACACCTTCACCGAGTC
TGCAGTTTTGCTTACGTGCAGTCGTGGACATATTATTCCCCCAAATTCCTCATT
TCTAGGAGTATTCTGAAACTCTTGTACATTTCTTTTTCTGTTTTGCACACTGGG
CTTCAGAGTGTTGAAATCCTATCGgtatgtacagtgttatggga b576i10-h_980727_Contig197G 34566-34685 cctgtcatcctctttactgcagTGAGGAAGGGAAACTGTCTACCTCTCAAGATG
CTGCTTGTAAAGACGCAGAGGAGTGTCCCGAGACTGCAGAGGCGAAGTGCGCGG
CGCCCAGGCCTCCCAGCAGCAGTCCCGAGCAGAGgtaaccacccgcctcctcaa
a b576i10-h_970727_Contig197G 29252-31523 agGACTGGCCAACCAAGCGCACCAGGTGACACTTCAGTGAATGGCCCTGTATGA
CGGGTGACGTCTGCTGCTGCTGACTGAGGACTGCAGACCGCCACCACTCAGGGG
CTCTGGAGGGGTCAGCTGGAGCCCACCAAGCTGTCACTGCTGCACTCACTCTGC
AAGGGATCAGGACCAGCAACCTTTATATTCTAGATTCTAAGACATTGTACAGAG
AAATTCAGAAGTGTAAAAATATTGCACATTGACAAATACCAAGAATTTTTGCGT
ATGTTTATATTGTATTGTTCTAAATAATGGGTAGCCTGTGAAATAAGATCTTGC
CACCCATGTAATAATAGTAGTAATACTATAGTTAAAATGGCTGTAAGAATAGTT
TTATAAAAGTGAATACACAGATCTATTGTATTTGAAACATAACTTTGACAATTA
TTAGTGTGACCAAAGTATTAGGCGGTTTTCATACATTTTTCACCTTGTACAAAA
TTATGAATTCATTTTTCCTCCAGGCCGACAAGGAGTTGTAGAATGAAAATGCCC
TCTAAGTGTTATTTTGGTTGTTCTAACTTACAAAAGTGATTTGAATAAGAAAT
ATTTGGTGTTCTTTTATAACCAGTTTTGATTGGTAATTGTTTCTGTATTGT
TTAAAACGGATCAAAAATGTAAGTCTATTGGTAGAGATTAAGTAAAGTATTTAT
TGCTACATCATAGTTGATAAATTGATGTTATCGTAAAGCCATATGTTCTGTTCA
AGTCTTGTTTGCTTGAAATGATTATTCCTACAAGTGAAACACTAGACTATTTGG
AGTGTATATGGCTTGTGTTTTGGGATTTTTTTTTTTTTTTGGCTTTTGTTT
TTGTTTGTTTTTTTGTTTCATTTGGTAGTTCA

FIG.4D

```
TCTGCCTTTTAACCCATTCACCAAAATTTACCTTGTTAACAAGCATCACCAATG
AACATTTCAGAGCAATCTGCATATTTAACAGACCTAAAATAAATCCTATTAGGC
AAGTCAGTTGAAAATGCTCGTGCTGCTAATGGAATTAGAGTGCGTTCATTTTAC
AGGCTAGTATTTTAAAAGTAGAAATCAAAATCTGGCACCGAAGCATGCTAATTG
TTTACTGTACCTTGTGAGGTTTTCACTCATAAATTTAAACCAGTGTATTTTTTT
AGAACTGGTTTGTGTATATATATAGTGATTATGGATACTAATTCAATGTAATTT
ATAATTTTCTATGTCAATACAAAATACATCACAGCCTTCTCAAACAGCTCAAG
CAATATATTGTATATTGCCATATCGTCTGGTGAAAGGGTTAAATTACTTCACCT
CTTGCACTTTTAGATGCAAATCAGTTTTTCATTTCTGTAATAGAAAATTATTCA
CGTATTTTTACATCATTTGTTTTTCCTGACCAGTATTTAAAACCAAAAGGATAT
TCTGAAAAATGGCCAACAATTTTTTTAGAAGTAGCATCCCAAGCAGCGTGCCTA
AACATTACATTGCATATGGAAATAAAAGAATCAAACGTCTAATGCCTTATTATT
TCTGATTTCCTTTTTCATTTTAAGTGGTGTGGAGATTCCAGCACTCCCAGGACA
GTGGAGTCAGCAGTAAGCCCTGGGACAGGTGGCAAGGGTGGGTCCCTTGACCTT
TGCACGCCTCCTCAGGAACCCCCTTTCCCGGGTGAGCCCCTCTCTGAAGAGACT
GTCCTTGGGCCTCCTCTGGAAGCAGCACCCCAGAGGACAGGGCTCCTCCTGCT
TGCCTCAGGGCTGCCTGACTTGAATGGCGTTGGACCTCGGGGATTACTGGTAGA
TAATATGCTCTGGTCTCGCCTGGTGGTGAGTTTTGCCAGCCATGGCCAGGGTTT
GGCTCCACTGGTGGCACACGTGGCCTCCGTGGTATGGACCTGGTGGCTTCTCCA
TCCCACTGTGGCCTCTGTGGTATGGACCTGGTGGCTTCTCCATCCTACCCAAGG
TAACAGTGTCTTGCTTCATCCCACTGACTGCTGGGAGAGAGCCTCTGGGACTTT
TCTTTGGGGCATCATTTTGTTTTGTCTTTCGTAGCAGGGAAAGGATATGACAAT
GGGGAGGACAGTTCTTTTGGAGGTTGGAGGGGCCAAGCCAAGGACAGGAGCAAG
TGTGCCCTCATTTTGTTTCTACTTTTAATTTCTGTGTGTTGGCCATACTGAATT
ATGAGACTAACAGATGTCTACAATACAATACCTGTATTCAAAATAACAAAAATA
AAGCCTGATTCTTTGTTTCTAGaaaaaaaaaaaaa
```

FIG.4E

Zmax8A b442p6-h_980814_Contig299G 332-213 tgcgggcggcagggcagcGGGGCGATGAGGTGAGGACGCCCGGGAACCGGAGG
CGGCACCGCGCGGCGCACGGACCTGGGACGCGGAGTCCTGAAGCCGGCGGACG
GTTTTCGTACGGGCGGCCGTGCGCGAGGCGAGgtgaggcccc b442p6-h_980814_Contig300G 109213-108978 tgtttctgttagGAGAGAACATTGAAAGTATTCTCTAAGCTATTTGAAGAGAG
TGACTAAATGCACCTGGGTCAGGCTGTCTGTGGGTATGAAGTGGTTGGGAGAA
TCCAAGAACATGGTGGTGAATGGCAGGAGAAATGGAGGCAAGTTGTCTAATGA
CCATCAGCAGAATCAATCAAAATTACAGCACACGGGGAAGGACACCCTGAAGG
CTGGCAAAATGCAGTCGAGAGGAGGTCGAACAGATgtatgtacacttaaa
cct b442p6-h 980814 Contig300G 104989-104842 cttgcttttgcttttcacagGTAATGGTAACTCGGGATTTGAAGGACAGAGTC
GCTATGTACCATCCTCTGGAATGTCCGCCAAGGAACTCTGTGAAAATGATGAC
CTAGCAACCAGTTTGGTTCTTGATCCCTATTTAGGTTTTCAAACACACAAAAT
GAATACTAGgtaattttcagtctttatcc b442p6-h_980814_Contig300G 99292-99178 tgttgtttgttttgcatttatatagCGCCTTTCCTTCGAGGAGCTCAAGGCA
TTTTTCAAAATCTGACAGTTTTTCTCACAACAACCCTGTGAGgtaggtagtgt
gtgttaaaa b442p6-h_980814_Contig300G 94248-94084 tcattcttttgatttctttcagATTTAGGCCTATTAAAGGAAGGCAGGAAGAA
CTAAAGGAAGTAATTGAACGTTTTAAGAAAGATGAACACTTGGAGAAAGCCTT
CAAATGTTTGACTTCAGGCGAATGGGCACGGCACTATTTTCTCAACAAGAATA
AAATGCAGGAGAAATTATTCAAAGAACATgtaagtttattaagactgat b442p6-h_980814_Contig300G 92978-92869 ttttttttttcctgttttagGTATTTATTTATTTGCGAATGTTTGCAACTGAC
AGTGGATTTGAAATATTGCCATGTAATAGATACTCATCAGAACAAAATGGAGC
CAAAATAGTTGCAACAAAGAGTGgtaactattctactagtataa

FIG. 5A b442p6-h_980814_Contig300G 90784-90616 cacatcacatattttaaatagGAAACGAAATGACAAAATAGAATTACTGGTGG
GTTGTATTGCCGAACTTTCAGAAATTGAGGAGAACATGCTACTTAGACATGGA
GAAAACGACTTCAGTGTCATGTACTCCACAAGGAAAAACTGTGCTCAACTCTG
GCTGGGTCCTGCTGCGTTTATAAACCATGgtaagctgtgtttccaaggt b442p6-h_980814_Contig300G 90324-90302 atcttttggacattttcagATTGCAGACCTAATTGTAAGgtaagcattaaaa
aaatttt b442p6-h_980814_Contig300G 90227-90088 tactgagttacttttattttagTTTGTGTCAACTGGTCGAGATACAGCATGTG
TGAAGGCTCTAAGAGACATTGAACCTGGAGAAGAAATTTCTTGTTATTATGGA
GATGGGTTCTTTGGAGAAAATAATGAGTTCTGCGAGTGTTACACTTGCGAAAG
gtaaggtattaagtaaaatg b442p6-h_980814_Contig300G 86251-86055 cctgtgctatttctctttcagACGGGGCACTGGTGCTTTTAAATCCAGAGTG
GGACTGCCTGCGCCTGCTCCTGTTATCAATAGCAAATATGGACTCAGAGAAAC
AGATAAACGTTTAAATAGGCTTAAAAAGTTAGGTGACAGCAGCAAAAATTCAG
ACAGTCAATCTGTCAGCTCTAACACTGATGCAGATACCACTCAGGAAAAAAAC
AATGCAAgtaagtaagggagatttgat b442p6-h_980814_Contig300G 78242-76180 ttttctctttaaccttacagCTTCTAACCGAAAATCTTCAGTTGGCGTAAAAA
AGAATAGCAAGAGCAGAACGTTAACGAGGCAATCTATGTCAAGAATTCCAGCT
TCTTCCAACTCTACCTCATCTAAGCTAACTCATATAAATAATTCCAGGGTACC
AAAGAAACTGAAGAAGCCTGCAAAGCCTTTACTTTCAAAGATAAAATTGAGAA
ATCATTGCAAGCGGCTGGAGCAAAAGAATGCTTCAAGAAAACTCGAAATGGGA
AACTTAGTACTGAAAGAGCCTAAAGTAGTTCTGTATAAAAATTTGCCCATTAA
AAAAGATAAGGAGCCAGAGGGACCAGCCCAAGCCGCAGTTGCCAGCGGGTGCT
TGACTAGACACGCGGCGAGAGAACACAGACAGAATCCTGTGAGAGGTGCTCAT
TCGCAGGGGGAGAGCTCGCCCTGCACCTACATAACTCGGCGGTCAGTGAGGAC
AAGAACAAATCTGAAGGAGGCCTCTGACATCAAGCTTGAACCAAATACGTTGA
ATGGCTATAAAGCAGTGTGACGGAACCTTGCCCCGACAGTGGTGAACAGCTG
CAGCCAGCTCCTGTGCTGCAGGAGGAAGAACTGGCTCATGAGACTGCACAAAA
AGGGGAGGCAAAGTGTCATAAGAGTGACACAGGCATGTCCAAAAAGAAGTCAC
GACAAGGAAAACTTGTGAAACAGTTTGCAAAAATAGAGGAATCTACTCCAGTG
CACGATTCTCCTGGAAAAGACGACGCGGTACCAGATTTGATGGGTCCCCATTC
TGACCAGGGTGAGCACAGTGGCACTGTGGGCGTGCCTGTGAGCTACACAGACT
GTGCTCCTTCACCCGTCGGTTGTTCAGTTGTGACATCAGATAGCTTCAAAACA

FIG. 5B

```
AAAGACAGCTTTAGAACTGCAAAAAGTAAAAAGAAGAGGCGAATCACAAGGTA
TGATGCACAGTTAATCCTAGAAAATAACTCTGGGATTCCCAAATTGACTCTTC
GTAGGCGTCATGATAGCAGCAGCAAAACAAATGACCAAGAGAATGATGGAATG
AACTCTTCCAAAATAAGCATCAAGTTAAGCAAAGACCATGACAACGATAACAA
TCTCTATGTAGCAAAGCTTAATAATGGATTTAACTCAGGATCAGGCAGTAGTT
CTACAAAATTAAAAATCCAGCTAAAACGAGATGAGGAAATAGGGGTCTTAT
ACAGAGGGGCTTCATGAAAATGGGGTGTGCTGCAGTGATCCTCTTTCTCTCTT
GGAGTCTCGAATGGAGGTGGATGACTATAGTCAGTATGAGGAAGAAAGTACAG
ATGATTCCTCCTCTTCTGAGGGCGATGAAGAGGAGGATGACTATGATGATGAC
TTTGAAGACGATTTTATTCCTCTTCCTCCAGCTAAGCGCTTGAGGTTAATAGT
TGGAAAAGACTCTATAGATATTGACATTTCTTCAAGGAGAAGAGAAGATCAGT
CTTTAAGGCTTAATGCCTAAGCTCTTGGTCTTAACTTGACCTGGGATAACTAC
TTTAAAGAAATAAAAAATTCCAGTCAATTATTCCTCAACTGAAAGTTTAGTGG
CAGCACTTCTATTGTCCCTTCACTTATCAGCATACTATTGTAGAAAGTGTACA
GCATACTGACTCAATTCTTAAGTCTGATTTGTGCAAATTTTATCGTACTTTT
TAAATAGCCTTCTTACGTGCAATTCTGAGTTAGAGGTAAAGCCCTGTTGTAAA
ATAAAGGCTCAAGCAAAATTGTACAGTGATAGCAACTTTCCACACAGGACGTT
GAAAACAGTAATGTGGCTACACAGTTTTTTTAACTGTAAGAGCATCAGCTGGC
TCTTTAATTATGACTAAACAATAATTTAAAACAAATCATAGTAGCAGCATATT
AAGGGTTTCTAGTATGCTAATATCACCAGCAATGATCTTTGGCTTTTTGATTT
ATTTGCTAGATGTTTCCCCCTTGGAGTTTTGTCAGTTTCACACTGTTTGCTGG
CCCAGGTGTACTGTTTGTGGCCTTTGTTAATATCGCAAACCATTGGTTGGGAG
TCAGATTGGTTTCTTaaaaaaaaaaaaaaacgac
```

FIG.5C

Zmax8B b442p6-h_980814_Contig299G 332-213 tgcgggcggcagggcagcGGGGCGATGAGGTGAGGACGCCCGGGAACCGGAGG
CGGCACCGCGCGGCGCACGGACCTGGGACGCGGAGTCCTGAAGCCGGCGGACG
GTTTTCGTACGGGCGGCCGTGCGCGAGGCGAGgtgaggcccc b442p6-h_980814_Contig300G 109213-108978 tgtttctgttagGAGAGAACATTGAAAGTATTCTCTAAGCTATTTGAAGAGAG
TGACTAAATGCACCTGGGTCAGGCTGTCTGTGGGATGAAGTGGTTGGGAGAA
TCCAAGAACATGGTGGTGAATGGCAGGAGAAATGGAGGCAAGTTGTCTAATGA
CCATCAGCAGAATCAATCAAAATTACAGCACACGGGAAGGACACCCTGAAGG
CTGGCAAAAATGCAGTCGAGAGGAGGTCGAACAGATgtatgtacacacttaaa
cct b442p6-h_980814 Contig300G 104989-104842.

cttgcttttgcttttcacagGTAATGGTAACTCGGGATTTGAAGGACAGAGTC
GCTATGTACCATCCTCTGGAATGTCCGCCAAGGAACTCTGTGAAAATGATGAC
CTAGCAACCAGTTTGGTTCTTGATCCCTATTTAGGTTTTCAAACACACAAAAT
GAATACTAGtaattttcagtctttatcc b442p6-h_980814_Contig300G 99292-99178 tgttgtttgttttgcatttatatagCGCCTTTCCTTCGAGGAGCTCAAGGCA
TTTTTCAAAATCTGACAGTTTTTCTCACAACAACCCTGTGAGgtaggtagtgt
gtgttaaaa b442p6-h_980814_Contig300G 94248-94084 tcattcttttgatttctttcagATTTAGGCCTATTAAAGGAAGGCAGGAAGAA
CTAAAGGAAGTAATTGAACGTTTTAAGAAAGATGAACACTTGGAGAAAGCCTT
CAAATGTTTGACTTCAGGCGAATGGGCACGGCACTATTTTCTCAACAAGAATA
AAATGCAGGAGAAATTATTCAAAGAACATgtaagtttattaagactgat b442p6-h_980814_Contig300G 92978-92869 ttttttttttcctgttttagGTATTTATTTATTTGCGAATGTTTGCAACTGAC
AGTGGATTTGAAATATTGCCATGTAATAGATACTCATCAGAACAAAATGGAGC
CAAAATAGTTGCAACAAAGAGTGgtaactattctactagtataa

FIG. 6A b442p6-h_980814_Contig300G 90784-90616 cacatcacatattttaaatagGAAACGAAATGACAAAATAGAATTACTGGTGG
GTTGTATTGCCGAACTTTCAGAAATTGAGGAGAACATGCTACTTAGACATGGA
GAAAACGACTTCAGTGTCATGTACTCCACAAGGAAAAACTGTGCTCAACTCTG
GCTGGGTCCTGCTGCGTTTATAAACCATGgtaagctgtgtttccaaggt b442p6-h_980814_Contig300G 90324-90302 atcttttggacattttcagATTGCAGACCTAATTGTAAGgtaagcattaaaa
aaatttt b442p6-h_980814_Contig300G 90227-90088 tactgagttacttttatttagTTTGTGTCAACTGGTCGAGATACAGCATGTG
TGAAGGCTCTAAGAGACATTGAACCTGGAGAAGAAATTTCTTGTTATTATGGA
GATGGGTTCTTTGGAGAAAATAATGAGTTCTGCGAGTGTTACACTTGCGAAAG
gtaaggtattaagtaaaatg b442p6-h_980814_Contig300G 86251-86055 cctgtgctatttctctttcagACGGGGCACTGGTGCTTTTAAATCCAGAGTG
GGACTGCCTGCGCCTGCTCCTGTTATCAATAGCAAATATGGACTCAGAGAAAC
AGATAAACGTTTAAATAGGCTTAAAAAGTTAGGTGACAGCAGCAAAAATTCAG
ACAGTCAATCTGTCAGCTCTAACACTGATGCAGATACCACTCAGGAAAAAAAC
AATGCAAgtaagtaagggagatttgat b442p6-h_980814_Contig300G 78242-73019 tttaaccttacagCTTCTAACCGAAAATCTTCAGTTGGCGTAAAAAGAATAG
CAAGAGCAGAACGTTAACGAGGCAATCTATGTCAAGAATTCCAGCTTCTTCCA
ACTCTACCTCATCTAAGCTAACTCATATAAATAATTCCAGGGTACCAAAGAAA
CTGAAGAAGCCTGCAAAGCCTTTACTTTCAAAGATAAAATTGAGAAATCATTG
CAAGCGGCTGGAGCAAAAGAATGCTTCAAGAAAACTCGAAATGGGAAACTTAG
TACTGAAAGAGCCTAAAGTAGTTCTGTATAAAAATTTGCCCATTAAAAAAGAT
AAGGAGCCAGAGGGACCAGCCCAAGCCGCAGTTGCCAGCGGGTGCTTGACTAG
ACACGCGGCGAGAGAACACAGACAGAATCCTGTGAGAGGTGCTCATTCGCAGG
GGGAGAGCTCGCCCTGCACCTACATAACTCGGCGGTCAGTGAGGACAAGAACA
AATCTGAAGGAGGCCTCTGACATCAAGCTTGAACCAAATACGTTGAATGGCTA
TAAAAGCAGTGTGACGGAACCTTGCCCCGACAGTGGTGAACAGCTGCAGCCAG

FIG. 6B

```
CTCCTGTGCTGCAGGAGGAAGAACTGGCTCATGAGACTGCACAAAAGGGGAG
GCAAAGTGTCATAAGAGTGACACAGGCATGTCCAAAAAGAAGTCACGACAAGG
AAAACTTGTGAAACAGTTTGCAAAAATAGAGGAATCTACTCCAGTGCACGATT
CTCCTGGAAAAGACGACGCGGTACCAGATTTGATGGGTCCCCATTCTGACCAG
GGTGAGCACAGTGGCACTGTGGGCGTGCCTGTGAGCTACACAGACTGTGCTCC
TTCACCCGTCGGTTGTTCAGTTGTGACATCAGATAGCTTCAAAACAAAAGACA
GCTTTAGAACTGCAAAAGTAAAAGAAGAGGCGAATCACAAGGTATGATGCA
CAGTTAATCCTAGAAAATAACTCTGGGATTCCCAAATTGACTCTTCGTAGGCG
TCATGATAGCAGCAGCAAAACAAATGACCAAGAGAATGATGGAATGAACTCTT
CCAAAATAAGCATCAAGTTAAGCAAAGACCATGACAACGATAACAATCTCTAT
GTAGCAAAGCTTAATAATGGATTTAACTCAGGATCAGGCAGTAGTTCTACAAA
ATTAAAAATCCAGCTAAAACGAGATGAGGAAAATAGGGGGTCTTATACAGAGG
GGCTTCATGAAATGGGGTGTGCTGCAGTGATCCTCTTTCTCTCTTGGAGTCT
CGAATGGAGGTGGATGACTATAGTCAGTATGAGGAAGAAAGTACAGATGATTC
CTCCTCTTCTGAGGGCGATGAAGAGGAGGATGACTATGATGATGACTTTGAAG
ACGATTTTATTCCTCTTCCTCCAGCTAAGCGCTTGAGGTTAATAGTTGGAAAA
GACTCTATAGATATTGACATTCTTCAAGGAGAAGAGAAGATCAGTCTTTAAG
GCTTAATGCCTAAGCTCTTGGTCTTAACTTGACCTGGGATAACTACTTTAAAG
AAATAAAAAATTCCAGTCAATTATTCCTCAACTGAAAGTTTAGTGGCAGCACT
TCTATTGTCCCTTCACTTATCAGCATACTATTGTAGAAAGTGTACAGCATACT
GACTCAATTCTTAAGTCTGATTTGTGCAAATTTTATCGTACTTTTAAATAG
CCTTCTTACGTGCAATTCTGAGTTAGAGGTAAAGCCCTGTTGTAAAATAAAGG
CTCAAGCAAAATTGTACAGTGATAGCAACTTTCCACACAGGACGTTGAAAACA
GTAATGTGGCTACACAGTTTTTTTAACTGTAAGAGCATCAGCTGGCTCTTTAA
TATATGACTAAACAATAATTTAAAACAAATCATAGTAGCAGCATATTAAGGGT
TTCTAGTATGCTAATATCACCAGCAATGATCTTTGGCTTTTGATTTATTTGC
TAGATGTTTCCCCCTTGGAGTTTTGTCAGTTTCACACTGTTTGCTGGCCCAGG
TGTACTGTTTGTGGCCTTTGTTAATATCGCAAACCATTGGTTGGGAGTCAGAT
TGGTTTCTTAAAAAAAAAAAAAAAACGACATACGTGACAGCTCACTTTTCAGT
TCATGATATGTACGAGGGTAGCAGTGTGTGGGATGAGGTTCGATACAGCGTAT
TTATTGCTTGTCATGTAAATTAAAAACCTTGTATTTAACTCTTTTCAATCCTT
TTAGATAAAATTGTTCTTTGCAAGAATGATTGGTGCTTATTTTTCAAAAATT
TGCTGTGAACAACGTGATGACAACAAGCAACATTTATCTAATGAACTACAGCT
ATCTTAATTTGGTTCTTCAAGTTTTCTGTTGCACTTGTAAATGCTACAAGGA
ATATTAAAAAATCTATTCACTTTAACTTATAATAGTTTATGAAATAAAAACA
TGAGTCACAGCTTTTGTTCTGTGGTAACCTATAAAAAAGTTTGTCTTTGAGA
TTCAATGTAAAGAACTGAAAACAATGTATATGTTGTAAATATTTGTGTTGT
GAGAAATTTTTGTCATAAGAATTAAAGAACTTACCAGGAAGGTTTTTAAGT
TTAGAAATATTCATGCCAATAAAATAGGAATTATAAATATATAGTTTTAAGC
ACTGCATCAGTGGGAGTTCTTGGCTTATGTTAGTTTATGTTAGTTTATTATGA
AAACATCAAAGATTTTTTGACTATATTATCAGTTAAACAAAAGGAGTCAGA
TTTAATTTGTTTTTTGAAGCACTTTGAGAAATTAATTTTAATTAACTTAATGA
GCAAATTTTTATTACTACTTTATGTTCAATACCAGGTTCTTTTCATTTCTCTG
```

FIG.6C

```
GATTATTTTGCAAATCATTGGACAGAGAATTTGGGAATATAAATCTGTAACAG
GTGTTTGACACCAGTAGGTCTCTTTATTTCTGGGAAATGTGTACCTGTACTTT
CTGATATACAGTGTTCCTAAGTAAAAATCAATTCAGGGGATTTGTATAGTGTC
TATAGGAAAGTAGCCCATGTCTTGAAATATGAAAGGAATCTGAAGGTCATGA
AAAGTCCAGTGGAGAAATCTCAATGCTTACTGTTACTACTAATTGATTCCTA
CTAGTTTCCAGGTTTGGGGGATATTGTTTCAATGACGCTCCTTAAGACTGTT
GATTGCCCATAGGTTCCAAATAGAAATTAAGACTCATGAACATTTTTAGAAAG
TAGATTGTTTTCTCCTGGTTCTCTAAGGAACTACTTCTGCAGTCTTACATAGT
CTCATCCTTGTTTGTTGTGGTGCAGTCGAACTCCTCAGGCGTTTGGAAAGCAT
GTGGTAGACCTTCTTCCACACCCACCCATACCCCGTTCACTGCGTCTGGAGG
TCTTCAACAGTGAAGTAGGGCAGCCCACACAGCCTCTCAGGAGCACCTGTCCG
AGGCACCCGGAGCACTTTGCAGAGCACGTCCAGCCCTCATGGGGTCCCTGCAT
AGAAATGTGAACCCCTGCCACTGAGGAAGATGAAGGTAGACCCTGTGTCTGGA
GGTGCTGGAGGGCAGCGGGTCACCTCTTGTATTCCCACCTTAGTTTGGGGTGT
TTTGAAGAGGTTCAGAGACTAAATCTTAAACCTTATTTGAATACCAACGATAG
CTATTTTGGGAATTTCGATCTTAAAAAGTGACAAAACACATTTCCCATTTTCA
TTTTTCAGCTGAATTTTAGTAACTTATTTTTGATGTTTTAATTTTATCATGGC
CTCCTCTTTGGAGGCCAACCTTCCCATGGGTCTCAAAGCAGTGACATTTGGTA
GTAAATCACTGCCTCTCAGGAGTCGGTATGCACAAGCACTCAGCAGCCACTGT
TGATGCCTTCTAGGGAAACCTAATTTCCGTTGGTAAAGGTAGGGGCCTCGGAA
CTGTTCCGGATCTGCTGTAGAACTTCACCGTGTGGAATGGTGACAGCCACACA
CCGTTGACCAGTTTAGAAGAGGTTGCATTCAATAAAACTCTTAGCTTGAGCTT
ATGCAATGATTGGTTAAGATTTGGCATTGTAAGAATTAGGAGATGATCATAG
AAATATATGTAAAGTATTCAATTTTCAATCATTTTCAAATTACTGTTATAAAT
TGTTTTTGCTGAGTTGTAATACTTTTGAGATACAATGTATTCCTTGTACTGAA
AGAATGAAAAGGACTTTTTCAGCATTTGAGGTAAGTTCTTTAACGTTTCATT
AAAAACATTTTTTACAAATATTTGTACATGCACTTGCAGTATTGAGGTTAAT
CATTTTAATAAATTCGGAAATTAAAACAATTTGGCCGGTGTTCACTGTATCTG
AAAAGAAAAAAAAAGATCAAAGTGGTGACTTTCTCCACAAAATTTTCATGTA
AAACAATTTGTAAAATCAATTTCTAAAGCTTTTCAATACCTGTGAGTGTTGAG
TTCTCTGGGCCCTGGTCTCTTGTGTCTGGTGCCACTCATTTTTAAGAGAAGAG
AGGGTAAACATACATTCTTCTTTTAGTAGGGAGACTAAACTACATACCTTCCT
AGTCCTTGAACCCAAGAAATGTTTGCCCTCAACATGGAGCACAATAACATCGA
AGGCTTTTGCAACCCAAATGCATTAATAGTTCCTGATTACTTGGAGTTGTTTT
TTTCCCCCCTCTCCGTATTGGTCAAAGTTAGCATACTCATGACTGGCCTGGGT
CCTTTTTTCACCCATTTACTGTTGAAATATGACTGTACAGGAGAGAGGAAACC
TGCAACATCTGAGTATCCCTGAGCAAGCTGCTTAATCTCCACATCTCTTTCCT
GGCACCCAGCATCATTCTGTGCCGGAGATCAGTGTGGACGCCTGGTCCCGTCA
TCAGTTAAGTTTCTGGTTGAGCTGCATTCACTCATGAGGATAATCTGGGTGAG
TGCTGCACACACGGGACTAGTCAAGTATTGATTATTGATTTTCCTAATTGAT
```

FIG. 6D

```
TGAAGTATCCACCCAAACTTGGGTTCCCAGTATAGAAAAAGGCTAAGCGTGGC
ATGTCTGTTAAGTACTTAGGAGTCTTGTTCAGCATCTCAGGTTTTCTCTCTAC
TCTTCCAATAGCCAATGGTAGCTAACTTGCCGGGAGCCCTTGTGTGACTCGTT
TCTCAAATGTCAACTTTCTGTCACTGACCTGCTGCACCGTTGCGTACTCTGCT
GCAGAACCCAGTCGCACCCAGAGCAGAGTACAAGCAAGTTGccagctccaggg
cactccctg
```

FIG. 6E

Zmax20

14608-14501 b180d17 Contig 11 ggccgaggctGCGGGAAGATGGCGGCGGCCATGGCAGCATCTTCCCTGA
CGGTCACCTTAGGGCGGCTGGCGTCCGCGTGCAGCCACAGCATCCTGAG
ACCTTCGGGGCCCGGAGCAGgtgagacctg 11383-11325 b180d17 Contig 11 cttccctcagCCTCCCTTTGGTCTGCTTCTCGAAGGTTCAATTCACAGA
GCACTTCATATCTACCAGGgtaatatcaa 8790-8705 b180d17 Contig 11
aaatgtgttttacagATATGTTCCTAAAACATCCCTGAGTTCACCACCT
TGGCCAGAAGTTGTTCTGCCAGACCCAGTTGAGGAGACCAGACACCATG
CAGgtaagacctccctg 7454-7291 b180d17 Contig 11 ttccctgcagAGGTCGTGAAGAAGGTGAATGAGATGATCGTCACGGGG
CAGTATGGCAGGCTCTTTGCCGTGGTGCACTTTGCCAGCCGCCAGTGGA
AGGTGACCTCTGAAGACCTGATCTTAATTGGAAATGAACTAGACCTTGC
GTGTGGAGAGAGAATTCGACTGGAGAAGgtgagaccacc 4231-4179 b180d17 Contig 11 ttgaattttttcagGTCCTGCTGGTTGGGGCAGACAACTTCACGCTGCTT
GGCAAGCCACTCCTCGGgtaatggctgtga 3769-3666 b180d17 Contig 11 tcttccttctagAAAGGATCTTGTTCGAGTAGAAGCCACAGTCATTGAA
AAGACAGAATCATGGCCAAGAATCATTATGAGATTCAGGAAAAGGAAAA
ACTTCAAGAAGAAAGAAgtaagttagag 2209-2093 b180d17.Contig 11 cctttctttcagTCGTCACGACCCCGCAGACTGTCCTCCGGATAAACAG
CATTGAGATTGCTCCGTGTTTGTTGTGATTACCGAGTTAATACTTACAA
AAGGATAAAAATAAACTCCTGCTTCCCAAGGA

FIG. 7

Zmax61A 16983- 17163 b160d8_980304_Contig5
ccgtgcgcgcgtcagcaagaacgccagggacggggtctccgcgccTGCG
CAGTGAAGCTGGGCGCCTTCGGGGCTTGAGCTTCTGAGGGTCGGGTCCA
GCGCGTGGGCTGCTGGATGGCGGAACCCCAGGCGGAGTCGGAGCCCCTG
CTGGGCGGGGCCCGCGGCGGTGGCGGCGACTGGCCGGCGGGGCTGACCA
CTTACCGCAGCATCCAAGTCGGCCCTGgtgagccgccc 22085-22149 b160d8_980304_Contig5
tgtcccctctgcctgcagGTGCCGCGGCCAGGTGGGACCTCTGCATTGA
TCAGGCTGTGGTCTTCATCGAAGATGCTATTCAGgtcggtggcacctgc
tccctgtggcc 22775-22851 b160d8_980304_Contig5 gacttttcgcttgtagTACCGCTCCATCAACCACCGGGTGGATGCCAGC
TCGATGTGGCTTTACCGACGGTATTACTCGAACGTATGCCAACGgtgag
aacgcacccat 23229-23400 b160d8_980304_Contig5 tctgtcccctttccagGACTTTGAGCTTCACCATCTTCTTGATCCTGTT
TTTGGCTTTTATCGAGACCCCATCCTCACTCACCAGCACGGCGGACGTG
CGCTACCGCGCTGCCCCTGGGAGCCGCCCTGCGGCCTGACCGAGAGTG
TCGAGGTGCTCTGCCTGCTGGTCTTTGCGGCCGACCTCTCTGTGAAGgt
gaggcggg 25627-25748 b160d8_980304_Contig5 ctcacccgcccgtctctcttgcagGGTTACCTGTTCGGGTGGGCCCATT
TCCAGAAAAACCTTTGGCTGCTGGGCTACCTCGTGGTGCTGGTGGTGTC
TCTGGTGGACTGGACCGTGTCCCTGAGTCTCGTGTGTCATGAGgtaggt
ggtgaggc 30937-31043 b160d8_980304_Contig5 gggtctcttccagCCCCTGCGGATCCGCCGGCTTCTCCGTCCCTTCTTC
CTGCTGCAGAACTCCTCTATGATGAAGAAGACCTTGAAATGCATCCGCT
GGTCGCTGCCGGAAATGGCAGgtgggctcttggt
31948-32020 b160d8_980304_Contig5 tgctctcccccagCGTCGGGCTGCTGCTGGCCATCCACCTGTGCCTCTT
CACCATGTTCGGAATGCTGCTGTTCGCTGGTGGGAAGgtagggcacccg
tgg

FIG. 8A 35554-35656 b160d8_980304_Contig5 gcttctgctctcagCAGGATGATGGGCAGGACAGGGAGAGGCTGACCTA
CTTCCAGAACCTGCCTGAGTCTCTGACTTCCCTCCTGGTGCTGCTGACC
ACGGCCAACAACCCCGATGgtgcgtgcagggcca 38714-38780 b160d8_980304_Contig5 ctttttcttttagGTGATGATTCCTGCGTATTCCAAGAACCGGGCCTA
TGCCATCTTCTTCATAGTCTTCACTGTGATAGgtgagtgcaggtaacgt 39641-39705 b160d8_980304_Contig5 tctcctcttgaagGAAGCCTGTTTCTGATGAACCTGCTGACAGCCATCA
TCTACAGTCAGTTCCGGGGCTACCTGATGgtgagcgagctcccaa 40208-40308 b160d8_980304_Contig5 ccttcctctttgcagAAATCTCTCCAGACCTCGCTGTTTCGGAGGCGGG
TGGGAACCCGGGCTGCCTTTGAAGTCCTATCCTCCATGGTGGGGGAGGG
AGGAGCCTTCCCTCAGGCgtgagtgctgggcat 40912-40993 b160d8_980304_Contig5 tttccctgcagAGTTGGGGTGAAGCCCCAGAACTTGCTGCAGGTGCTTC
AGAAGGTCCAGCTGGACAGCTCCCACAGACAGGCCATGATGGAGgtacc
cgccccc 41198-41286 b160d8_980304_Contig5 ccttcctgtgcagAAGGTGCGTTCCTATGGCAGTGTTCTGCTCTCAGCT
GAGGAGTTTCAGAAGCTCTTCAACGAGCTTGACAGAAGTGTGGTTAAAG
AGgtaactggggccac 2510-2629 b160d8_980304_Contig4 gttccttgcccagCACCCGCCGAGGCCCGAGTACCAGTCTCCGTTTCTG
CAGAGCGCCCAGTTCCTCTTCGGCCACTACTACTTTGACTACCTGGGGA
ACCTCATCGCCCTGGCAAACCTGGTGTCCATTTGCgtgagtgtggattt
gcc 2762-2821 b160d8_980304_Contig4 tggcgttgcagGTGTTCCTGGTGCTGGATGCAGATGTGCTGCCTGCTGA
GCGTGATGACTTCATCCTGGGGgtaagttctgagc

FIG. 8B 2920-3048 b160d8_980304_Contig4 ctgccccttcagATTCTCAACTGCGTCTTCATTGTGTACTACCTGTTG
GAGATGCTGCTCAAGGTCTTTGCCCTGGGCCTGCGAGGGTACCTGTCCT
ACCCCAGCAACGTGTTTGACGGGCTCCTCACCGTTGTCCTGCTGgtaaa
gtaggcgca 5428-5527 b160d8_980304_Contig4 cccgtgtctctccccagGAGGCCGGAGATGGTGGGCCTGCTGTCGCTGT
GGGACATGACCCGCATGCTGAACATGCTCATCGTGTTCCGCTTCCTGCG
TATCATCCCCAGCATGAAGgtgtgtgccggcccca 7911-7986 b160d8_980304_Contig4 ctgtcctcagCCGATGGCCGTGGTGGCCAGTACCGTCCTGGGCCTGGTG
CAGAACATGCGTGCGTTTGGCGGGATCCTGGTGgtgagtcccaggctgc
tg 9176-9252 b160d8_980304_Contig4 tcctggcccgccagGTGGTCTACTACGTATTTGCCATCATTGGGATCAA
CTTGTTTAGAGGCGTCATTGTGGCTCTTCCTGGAAACAGCAGgtgaggt
ggggtcc 9637-9718 b160d8_980304_Contig4 ttgtgttccccagCCTGGCCCCTGCCAATGGCTCGGCGCCCTGTGGGAG
CTTCGAGCAGCTGGAGTACTGGGCCAACAACTTCGATGACTTTGCGgtg
agccctgcgccc 9814-9900 b160d8_980304_Contig4 tctgccccgcagGCTGCCCTGGTCACTCTGTGGAACTTGATGGTGGTG
AACAACTGGCAGGTGTTTCTGGATGCATATCGGCGCTACTCAGGCCCgt
gagtcctcgtctccctga 10489-10570 b160d8_980304_Contig4
tgtcctccgcagGTGGTCCAAGATCTATTTTGTATTGTGGTGGCTGGTG
TCGTCTGTCATCTGGGTCAACCTGTTTCTGGCCCTGATTCTGGAGgtat
cagcgctcc 11114-11208 b160d8_980304_Contig4 tcctgcttgccagAACTTCCTTCACAAGTGGGACCCCCGCAGCCACCTG
CAGCCCCTTGCTGGGACCCCAGAGGCCACCTACCAGATGACTGTGGAGC
TCCTGTTCAGgtgtgtgggtgggga

FIG. 8C 11877-13998 b160d8_980304_Contig4 cctcaattccacagGGATATTCTGGAGGAGCCCGGGGAGGATGAGCTCA
CAGAGAGGCTGAGCCAGCACCCGCACCTGTGGCTGTGCAGGTGACGTCC
GGGCTGCCGTCCCAGCAGGGGCGGCAGGAGAGAGAGGCTGGCCTACACA
GGTGCCCATCATGGAAGAGGCGGCCATGCTGTGGCCAGCCAGGCAGGAA
GAGACCTTTCCTCTGACGGACCACTAAGCTGGGGACAGGAACCAAGTCC
TTTGCGTGTGGCCCAACAACCATCTACAGAACAGCTGCTGGTGCTTCAG
GGAGGCGCCGTGCCCTCCGCTTTCTTTTATAGCTGCTTCAGTGAGAATT
CCCTCGTCGACTCCACAGGGACCTTTCAGACAAAATGCAAGAAGCAGC
GGCCTCCCTGTCCCTGCAGCTTCGTGGTGCCTTTGCTGCCGGCAGC
CCTTGGGGACCACAGGCCTGACCAGGGCCTGCACAGGTTAACCGTCAGA
CTTCCGGGGCATTCAGGTGGGGATGCTGGTGGTTTGACATGGAGAGAAC
CTTGACTGTGTTTTATTATTTCATGGCTTGTATGAGTGTGACTGGGTGT
GTTTCTTTAGGGTTCTGATTGCCAGTTATTTTCATCAGTAAGTCTTGCA
AGAATGGGATTGTCATTCTTCACTTCAGCACAGTTCTAGTCCTGCTTC
TCTGGAGTAGGGTTGTTGAGTAAGGTTGCTTGGGTTGTGCATTGCACAA
GGGCACATGGCTGTGAGGTGTATCCTGGCGGGGGCTGTCTACCTGCAG
TGAGGGGCACCTTTTCTGTTTTGCTCAAAGGCATGTATAAGCCAATGGG
TGACCTTATTTCCTGTGTCTTCAGGTGTGTGGCAGGGGCCTGGGGTGG
GGAGGTGGGGCGAGCGAGCAGTGTGTGGAAAGCCTTGTTGTCACCTGAA
GCACGCCAGGTCCAGATTGACCAATGGTTTTCTCACTTCAGGGGCCAAC
CCACGCCCCCTTTCTGCTGAGGTTTGGGTGCCATCTAGTGGTGGATGG
GACTTGGTTGACTACATTTAAGGTAAGGTGGACCCAGCAACTCCCAGAA
ACAACTCCGGGGACACCACTCCCCATCACACTCCACACCGAGCCTGGTG
CCCGGTCTGTGCCCGAGCTCAGCGGGACCAGGAAGGGATGGGCCCTGCC
AGGGTTGCCCCTGCACTGTGCATTCTCGCCTGGGAGGCACAAGTTCTTT
CATCTGCTTTTCCTTCAGAGGTGCTGAGCCCACGCCATAGCCCCTGGGT
GGGGGAGGGGGCGACCCGAACAACAGTGCAGTCGGTATCGAGATTGGGG
AGAGGAGCGAGTCCAAGGAGAAAGTCATGAGTTTCTTTTTACTCGTGTT
GAATAATAACAATAACAATAACAATATGGAAACCACCGCAAAC
TTGGAGAAAAGTTGTAAGCACAGTAAAGAGAAGCTTCCTTCTGAGTCAG
TTGAGTGGTTGCCGTTCTGGCCCTGCACCCTCTGTGCTTTGGGACGGCG
TCCAACCCGCATTCATGTCAGGAGTGAGTCGCACGTGGCTTTGTGGTCA
TGGCGACTTAATCCGCCTGGACGGTGGCTCCGTCTCCCTGGGCTTAGAC
GACCTTGGCACTTCTGGAGATAAGCCCATGGCTCCCAGGTTGTGTTCAT
GTGACGTTTCCTTGTGGTAGGTTCTGGGTCTGCGTTTTGTCTAGGAGTG
TCACAGGATGGACACTGCCTCCTGGCAGGGCTGCCCAATGCAGTTAGC
CTCCTGCTGGTGTTCTCTCTTGTTGCTTGGTGAAGGTGGCCCTGGTCAG
CTTCTCCACTGCCCAGTGAACGACCCCTTTGTAATGAATGAGTGGGGAG
GTAGTGTGAAGCGATGCCAATATCCCATCCCTGTCAAACTGCCTTTACT
TTTTCCTTCCTTCCTTGCTCCCACCTGTGTGGATCCTGGTCCCTTCTTG
TATTCAGGGCTGTGGTCTGTTATGACATTTACTCTCAGGCTCAGGTCCT
GCTTGTTTGGCCCGTGGGAGCCCCTTCTTCTGCCTTTTGTGTTTTTTTT
GTTATGTACCTACAGTTCTTTAGCTGTTTCTTTACTTTCTGGTGCAAAA

FIG. 8D

```
AGATGTTCAAGCCTTATTTTATACTTGCCTGCCCCTTTCTCTTTCATTT
ATTGGAGTGAGCTGCAGCTCTAAGAAGACCTGTTCTTTTGAATGGAGAG
TAGCATCAGGAACCAGGATGTGGGTGCGAGGCGTGCTCCTGGCTGTTGC
AGATTGCTGCACCCGGGAGCTCTTAGTGGACAGAGCTAGAGGATATGTG
CACGTACTTCCATCTCTCTCTGTCTCATCTATTCACAGCTGGGAATG
ATACTAATACCTCCGATTTTAGCCCAGCACCACAGGGTACGTTCCAGTT
TTTCTCTCTTTCCATAGCTGTAAGGCCCTTTCTGGGAATGGTTCTCATT
CTCCTTAATCTATTATTGGGTCAGTTTTCCTGCATGTCCCCAGCCTCCC
ATCACTGCCACCCACTCCCCACAGAGATGCCCTGCTCATCCGACTGGGG
CTTTGACTCCCACACTGTGTACCCTCTTGTGTGGACGCCCTGCTGCCA
AAACCTTCAGCAAACAGCTTTCCAAATGGAAGTTGTCACTGTCAGGGCC
TTTACAATCAGCAACAGCAAATCTACATGCTGCTGAGGGTCCTGCCTC
ATTAAGATGCAATAAATATGTAAGTACATAAAAACAGCAATAGAAGAAA
CGTAATGCTTTTTTCTCAAATATGATGTCTACATAGAAAAGCCAAAATT
ATTAAGAATAGTAAGAATTCACCCAGCACTTTGGGAGGCCGAGGCGGGT
GGATCATGAGGTCAGGAGATCGAGACCATCCTGGCTAACAAGGTGAAAC
CCCGTCTCTACTAAAAATACAAAAAATTAGCCGGGCGCGGTGGCGGGCG
CCTGTAGTCCCAGCTACTGGGGAGGCTGAGGCAGGAGAATGGCGTGAAC
CCGGGAAGCGGAGCTTGCAGTGAGCCGAGATTGCGCCACTGCAGTCCGC
AGTCCAGCCTGGGCGACAGAGCGAGACTCCGTCTCAAAAAAAA
```

FIG.8E 16983- 17163 b160d8_980304_Contig5
ccgtgcgcgcgtcagcaagaacgccagggacggggtctccgcgccTGCGCA
GTGAAGCTGGGCGCCTTCGGGGCTTGAGCTTCTGAGGGTCGGGTCCAGCGC
GTGGGCTGCTGGATGGCGGAACCCCAGGCGGAGTCGGAGCCCCTGCTGGGC
GGGGCCCGCGGCGGTGGCGGCGACTGGCCGGCGGGGCTGACCACTTACCGC
AGCATCCAAGTCGGCCCTGgtgagccgccc 22085-22149 b160d8_980304_Contig5 tgtcccctctgcctgcagGTGCCGCGGCCAGGTGGGACCTCTGCATTGATC
AGGCTGTGGTCTTCATCGAAGATGCTATTCAGgtcggtggcacctgctccc
tgtggcc 22775-22851 b160d8_980304_Contig5 gacttttcgcttgtagTACCGCTCCATCAACCACCGGGTGGATGCCAGCTC
GATGTGGCTTTACCGACGGTATTACTCGAACGTATGCCAACGgtgagaacg
cacccat 23229-23400 b160d8_980304_Contig5 tctgtccccttttccagGACTTTGAGCTTCACCATCTTCTTGATCCTGTTTT
TGGCTTTTATCGAGACCCCATCCTCACTCACCAGCACGGCGGACGTGCGCT
ACCGCGCTGCCCCCTGGGAGCCGCCCTGCGGCCTGACCGAGAGTGTCGAGG
TGCTCTGCCTGCTGGTCTTTGCGGCCGACCTCTCTGTGAAGgtgaggcggg 25627-25748 b160d8_980304_Contig5 ctcacccgcccgtctctcttgcagGGTTACCTGTTCGGGTGGGCCCATTTC
CAGAAAAACCTTTGGCTGCTGGGCTACCTCGTGGTGCTGGTGGTGTCTCTG
GTGGACTGGACCGTGTCCCTGAGTCTCGTGTGTCATGAGgtaggtggtgag
gc 30937-31043 b160d8_980304_Contig5 gggtctcttccagCCCCTGCGGATCCGCCGGCTTCTCCGTCCCTTCTTCCT
GCTGCAGAACTCCTCTATGATGAAGAAGACCTTGAAATGCATCCGCTGGTC
GCTGCCGGAAATGGCCAGgtgggctcttggt 31948-32020 b160d8_980304_Contig5 tgctctcccccagCGTCGGGCTGCTGCTGGCCATCCACCTGTGCCTCTTCA
CCATGTTCGGAATGCTGCTGTTCGCTGGTGGGAAGgtagggcacccgtgg 35554-35656 b160d8_980304_Contig5 gcttctgctctcagCAGGATGATGGGCAGGACAGGGAGAGGCTGACCTACT
TCCAGAACCTGCCTGAGTCTCTGACTTCCCTCCTGGTGCTGCTGACCACGG
CCAACAACCCCGATGgtgcgtgcagggcca

FIG. 9A 38714-38780 b160d8_980304_Contig5 cttttttcttttagGTGATGATTCCTGCGTATTCCAAGAACCGGGCCTATG
CCATCTTCTTCATAGTCTTCACTGTGATAGgtgagtgcaggtaacgt 39641-39705 b160d8_980304_Contig5 tctcctcttgaagGAAGCCTGTTTCTGATGAACCTGCTGACAGCCATCATC
TACAGTCAGTTCCGGGGCTACCTGATGgtgagcgagctcccaa 40208-40308 b160d8_980304_Contig5 ccttcctctttgcagAAATCTCTCCAGACCTCGCTGTTTCGGAGGCGGCTG
GGAACCCGGGCTGCCTTTGAAGTCCTATCCTCCATGGTGGGGGAGGGAGGA
GCCTTCCCTCAGGCgtgagtgctgggcat 40912-40993 b160d8_980304_Contig5 tttccctgcagAGTTGGGGTGAAGCCCAGAACTTGCTGCAGGTGCTTCAG
AAGGTCCAGCTGGACAGCTCCCACAGACAGGCCATGATGGAGgtaccgcc
ccc 41198-41286 b160d8_980304_Contig5 ccttcctgtgcagAAGGTGCGTTCCTATGGCAGTGTTCTGCTCTCAGCTGA
GGAGTTTCAGAAGCTCTTCAACGAGCTTGACAGAAGTGTGGTTAAAGAGgt
aactggggccac 2510-2629 b160d8_980304_Contig4 gttccttgcccagCACCCGCCGAGGCCCGAGTACCAGTCTCCGTTTCTGCA
GAGCGCCCAGTTCCTCTTCGGCCACTACTACTTTGACTACCTGGGGAACCT
CATCGCCCTGGCAAACCTGGTGTCCATTTGCgtgagtgtggatttgcc 2762-2821 b160d8_980304_Contig4 tggcgttgcagGTGTTCCTGGTGCTGGATGCAGATGTGCTGCCTGCTGAGC
GTGATGACTTCATCCTGGGGtaagttctgagc 2920-3048 b160d8_980304_Contig4 ctgccccttcagATTCTCAACTGCGTCTTCATTGTGTACTACCTGTTGGA
GATGCTGCTCAAGGTCTTTGCCCTGGGCCTGCGAGGGTACCTGTCCTACCC
CAGCAACGTGTTTGACGGGCTCCTCACCGTTGTCCTGCTGgtaaagtaggc
gca

FIG. 9B 3862-3911 b160d8_980304_Contig4 ttcttttcttttgtaattaaagGTTTTGGAGATCTCAACTCTGGCTGTGTA
CCGATTGCCACACCCAGGCTGgtatgtgactgggcagaac 5428-5527 b160d8_980304_Contig4 cccgtgtctctccccagGAGGCCGGAGATGGTGGGCCTGCTGTCGCTGTGG
GACATGACCCGCATGCTGAACATGCTCATCGTGTTCCGCTTCCTGCGTATC
ATCCCCAGCATGAAGgtgtgtgccggcccca 7911-7986 b160d8_980304_Contig4 ctgtcctcagCCGATGGCCGTGGTGGCCAGTACCGTCCTGGGCCTGGTGCA
GAACATGCGTGCGTTTGGCGGGATCCTGGTGgtgagtcccaggctgctg 9176-9252 b160d8_980304_Contig4 tcctggcccgccagGTGGTCTACTACGTATTTGCCATCATTGGGATCAACT
TGTTTAGAGGCGTCATTGTGGCTCTTCCTGGAAACAGCAGgtgaggtgggg
tcc 9637-9718 b160d8_980304_Contig4 ttgtgttccccagCCTGGCCCCTGCCAATGGCTCGGCGCCCTGTGGGAGCT
TCGAGCAGCTGGAGTACTGGGCCAACAACTTCGATGACTTTGCGgtgagcc
ctgcgccc 9814-9900 b160d8_980304_Contig4 tctgcccccgcagGCTGCCCTGGTCACTCTGTGGAACTTGATGGTGGTGAA
CAACTGGCAGGTGTTTCTGGATGCATATCGGCGCTACTCAGGCCCgtgagt
cctcgtctccctga 10489-10570 b160d8_980304_Contig4 tgtcctccgcagGTGGTCCAAGATCTATTTTGTATTGTGGTGGCTGGTGTC
GTCTGTCATCTGGGTCAACCTGTTTCTGGCCCTGATTCTGGAGgtatcagc
gctcc 11114-11208 b160d8_980304_Contig4 tcctgcttgccagAACTTCCTTCACAAGTGGGACCCCCGCAGCCACCTGCA
GCCCCTTGCTGGGACCCCAGAGGCCACCTACCAGATGACTGTGGAGCTCCT
GTTCAGgtgtgtgggtgggga

FIG. 9C 11877-13998 b160d8_980304_Contig4

```
cctcaattccacagGGATATTCTGGAGGAGCCCGGGGAGGATGAGCTCACA
GAGAGGCTGAGCCAGCACCCGCACCTGTGGCTGTGCAGGTGACGTCCGGGC
TGCCGTCCCAGCAGGGGCGGCAGGAGAGAGAGGCTGGCCTACACAGGTGCC
CATCATGGAAGAGGCGGCCATGCTGTGGCCAGCCAGGCAGGAAGAGACCTT
TCCTCTGACGGACCACTAAGCTGGGGACAGGAACCAAGTCCTTTGCGTGTG
GCCCAACAACCATCTACAGAACAGCTGCTGGTGCTTCAGGGAGGCGCCGTG
CCTCCGCTTTCTTTTATAGCTGCTTCAGTGAGAATTCCCTCGTCGACTCCA
CAGGGACCTTTCAGACAAAAATGCAAGAAGCAGCGGCCTCCCCTGTCCCCT
GCAGCTTCCGTGGTGCCTTTGCTGCCGGCAGCCCTTGGGGACCACAGGCCT
GACCAGGGCCTGCACAGGTTAACCGTCAGACTTCCGGGGCATTCAGGTGGG
GATGCTGGTGGTTTGACATGGAGAGAACCTTGACTGTGTTTATTATTTCA
TGGCTTGTATGAGTGTGACTGGGTGTGTTTCTTTAGGGTTCTGATTGCCAG
TTATTTTCATCAGTAAGTCTTGCAAAGAATGGGATTGTCATTCTTCACTTC
AGCACAGTTCTAGTCCTGCTTCTCTGGAGTAGGGTTGTTGAGTAAGGTTGC
TTGGGTTGTGCATTGCACAAGGGCACATGGCTGTGAGGTGTATCCTGGCGG
GGGGCTGTCTACCTGCAGTGAGGGCACCTTTTCTGTTTTGCTCAAAGGCA
TGTATAAGCCAATGGGTGACCTTATTTCCTGTGTCTTCAGGTGTGTGGCAG
GGGGCCTGGGGTGGGGAGGTGGGGCGAGCGAGCAGTGTGTGGAAAGCCTTG
TTGTCACCTGAAGCACGCCAGGTCCAGATTGACCAATGGTTTTCTCACTTC
AGGGGCCAACCCACGCCCCCTTTCTGCTGAGGTTTGGGTGCCATCTAGTGG
TGGGATGGGACTTGGTTGACTACATTTAAGGTAAGGTGGACCCAGCAACTC
CCAGAAACAACTCCGGGGACACCACTCCCCATCACACTCCACACCGAGCCT
GGTGCCCGGTCTGTGCCCGAGCTCAGCGGGACCAGGAAGGGATGGGCCCTG
CCAGGGTTGCCCCTGCACTGTGCATTCTCGCCTGGGAGGCACAAGTTCTT
TCATCTGCTTTTCCTTCAGAGGTGCTGAGCCCACGCCATAGCCCCTGGGTG
GGGGAGGGGGCGACCCGAACAACAGTGCAGTCGGTATCGAGATTGGGGAGA
GGAGCGAGTCCAAGGAGAAAGTCATGAGTTTCTTTTACTCGTGTTGAATA
ATAACAATAACAATAACAATAACAATATGGAAACCACCGCAAACTTGGAGA
AAAGTTGTAAGCACAGTAAAGAGAAGCTTCCTTCTGAGTCAGTTGAGTGGT
TGCCGTTCTGGCCCTGCACCCTCTGTGCTTTGGGACGGCGTCCAACCCGCA
TTCATGTCAGGAGTGAGTCGCACGTGGCTTTGTGGTCATGGCGACTTAATC
CGCCTGGACGGTGGCTCCGTCTCCCTGGGCTTAGACGACCTTGGCACTTCT
GGAGATAAGCCCATGGCTCCCAGGTTGTGTTCATGTGACGTTTCCTTGTGG
TAGGTTCTGGGTCTGCGTTTTGTCTAGGAGTGTCACAGGATGGACACTGCC
TCCTGGCAGGGGCTGCCCAATGCAGTTAGCCTCCTGCTGGTGTTCTCTCTT
GTTGCTTGGTGAAGGTGGCCCTGGTCAGCTTCTCCACTGCCCAGTGAACGA
CCCCTTTGTAATGAATGAGTGGGGAGGTAGTGTGAAGCGATGCCAATATCC
CATCCCTGTCAAACTGCCTTTACTTTTCCTTCCTTCCTTGCTCCCACCTG
TGTGGATCCTGGTCCCTTCTTGTATTCAGGGCTGTGGTCTGTTATGACATT
TACTCTCAGGCTCAGGTCCTGCTTGTTTGGCCCGTGGGAGCCCCTTCTTCT
GCCTTTTGTGTTTTTTTTGTTATGTACCTACAGTTCTTTAGCTGTTTCTTT
ACTTTCTGGTGCAAAAGATGTTCAAGCCTTATTTATACTTGCCTGCCCC
TTTCTCTTTCATTTATTGGAGTGAGCTGCAGCTCTAAGAAGACCTGTTCTT
TTGAATGGAGAGTAGCATCAGGAACCAGGATGTGGGTGCGAGGCGTGCTCC
```

FIG. 9D

```
TGGCTGTTGCAGATTGCTGCACCCGGGAGCTCTTAGTGGACAGAGCTAGAG
GATATGTGCACGTACTTCCATCTCTCTCTCTGTCTCATCTATTCACAGCTG
GGAATGATACTAATACCTCCGATTTTAGCCCAGCACCACAGGGTACGTTCC
AGTTTTTCTCTCTTTCCATAGCTGTAAGGCCCTTTCTGGGAATGGTTCTCA
TTCTCCTTAATCTATTATTGGGTCAGTTTTCCTGCATGTCCCCAGCCTCCC
ATCACTGCCACCCACTCCCCACAGAGATGCCCTGCTCATCCGACTGGGGCT
TTGACTCCCACACTGTGTACCCTCTTGTGTGGACGCCCTGCTGCCAAAAC
CTTCAGCAAACAGCTTTCCAAATGGAAGTTGTCACTGTCAGGGCCTTTACA
ATCAGCAACAGCAAAATCTACATGCTGCTGAGGGTCCTGCCTCATTAAGAT
GCAATAAATATGTAAGTACATAAAAACAGCAATAGAAGAAACGTAATGCTT
TTTTCTCAAATATGATGTCTACATAGAAAAGCCAAAATTATTAAGAATAGT
AAGAATTCACCCAGCACTTTGGGAGGCCGAGGCGGGTGGATCATGAGGTCA
GGAGATCGAGACCATCCTGGCTAACAAGGTGAAACCCCGTCTCTACTAAAA
ATACAAAAAATTAGCCGGGCGCGGTGGCGGGCGCCTGTAGTCCCAGCTACT
GGGGAGGCTGAGGCAGGAGAATGGCGTGAACCCGGGAAGCGGAGCTTGCAG
TGAGCCGAGATTGCGCCACTGCAGTCCGCAGTCCAGCCTGGGCGACAGAGC
GAGACTCCGTCTCAAAAAAAA
```

FIG. 9E

Zmax7A 4.9kb transcript

```
   1  GGCCTGCTTGATACGTCCGCCCTTTTGGGCGCTTCGCTGATGGTGTCGGTGAGCGCGTTT    60
  61  CCCGCCTGAGCGCAACTAGCGGCGGGTCGTGGGCACCTCCAGATAAGAAAACAAGCTCTA   120
 121  GAGAGATGTGGTGACTTGCTCAAATAGTGACAGAACTTCCTCGGCCATATGGAGGGGTCA   180
 181  TATAATACCCTGTGTCTTCAGTTTGAGGAGAGCTTGTTCATATCCATATCCCACTGTA    240
 241  TTCCTGCTAATCTGCTAATGCAGTAAATTGGAGGAAAACTGTTACCAGGATAACCTGTAA   300
 301  TGGGCAAGGAGCCACAAAGAAGAAAACATTTCTTTTAAATTTTTAAACTTGGTTTGAAAGG   360
 361  TATCCAAATATATCTTGTGAGTTGCTCACTTCTGATGTCTCCCAGATGAATGATAGACTG   420
   1                                                 M  N  D  R  L      5
 421  GGAGAAGATGAATCCCTTGCTAATGAAATTATATAGCTTCCTCCTAAACGATTCCCCTTTG   480
   6   G  E  D  E  S  L  L  M  K  L  Y  S  F  L  N  D  S  P  L      25
 481  AATCCACTACTTGCCAGTTTCTTCAGCAAGGTGCTAAGTATTCTTATCAGCAGAAAACCA   540
  26   N  P  L  L  A  S  F  F  S  K  V  L  S  I  L  I  S  R  K  P   45
 541  GAACAGAGATTGTGGATTCTTAAAGAAGCATGATTTTGTAGACCTTATTATAAAGCAC    600
  46   E  Q  I  V  D  F  L  K  K  K  H  D  F  V  L  L  I  K  H      65
 601  ATAGGAACTTCTGCTATCATGGATTTGTTGCTCAGGCTCCTGACGTGTATCGAACCTCCA   660
  66   I  G  T  S  A  I  M  D  L  L  L  R  L  L  T  C  I  E  P  P   85
```

FIG. 15A

```
 661  CAGCCCAGGCAAGATGTGCTGAATTGGTTAAATGAGGAGAAAATTATCCAGAGGCTTGTG   720
  86   Q  P  R  Q  D  V  L  N  W  L  N  E  E  K  I  I  Q  R  L  V    105

721  GAAATAGTTCATCCATGCCAAGAAGATCGACATTCAAATGCATTCACAATCACTTTGT    780
 106   E  I  V  H  P  S  Q  E  E  D  R  H  S  N  A  S  Q  S  L  C    125

781  GAAATTGTTCGCCTGAGCAGAGACCAGATGTTACAAATTCAGAGAACAGTACAGAGCCCGAC  840
 126   E  I  V  R  L  S  R  D  Q  M  L  Q  I  Q  N  S  T  E  P  D    145

841  CCCCTGCTTGCCACTCTCTAGAAAAGCAAGAAATTATAGAGCAGCTTCTATCAAATATTTC   900
 146   P  L  L  A  T  L  E  K  Q  E  I  I  E  Q  L  L  S  N  I  F    165

901  CACAAGGAGAAAAATGAGTCAGCCATAGTCAGTGCAATCCAGATATTGCTGACTTTACTT   960
 166   H  K  E  K  N  E  S  A  I  V  S  A  I  Q  I  L  L  T  L  L    185

961  GAGACACGACGACCAACATTTGAAGGCCATATAGAGATCTGCCCACCAGGCATGAGCCAT  1020
 186   E  T  R  R  P  T  F  E  G  H  I  E  I  C  P  P  G  M  S  H    205

1021  TCAGCTTGTGTTCAGTAAACAAGAGTGTTCTAGAAGCCATCAGAGGAAGACTTGGATCTTTT  1080
 206   S  A  C  S  V  N  K  S  V  L  E  A  I  R  G  R  L  G  S  F    225

1081  CATGAACTCCTGCTGGAGCCACCAAGAAAAGTGTGATGAAGACCACATGGGTGTGCTG    1140
 226   H  E  L  L  L  E  P  P  K  K  S  V  M  K  T  M  G  V  L    245

1141  GATCCCTCCTGTGGGAATACCCGGTTGAATGTCATTAGGTTGATATCCAGCCTGCTTCAA   1200
 246   D  P  P  V  G  N  T  R  L  N  V  I  R  L  I  S  S  L  L  Q    265

1201  ACCAATACCAGCAGTATAAATGGGGACCTTATGGAGCTGAATAGCATTGGAGTCATATATTG  1260
 266   T  N  T  S  I  N  G  D  L  M  E  L  N  S  I  G  V  I  L    285
```

FIG. 15B

```
1261  AACATGTTCTTCAAGTATACATGAATAACTTTTTGCATACACAAGTGGAAATTTGTATT  1320
 286   N  M  F  F  K  Y  T  W  N  N  F  L  H  T  Q  V  E  I  C  I    305

1321  GCACTGATTCTTGCAAGTCCTTTTGAAAACACAGAAATGCCACAATTACCGATCAAGAC  1380
 306   A  L  I  L  A  S  P  F  E  N  T  E  N  A  T  I  T  D  Q  D    325

1381  TCCACTGGTGATAATTTGTTATTAAAACATCTTTTCCAAAAATGTCAATTAATAGAACGA  1440
 326   S  T  G  D  N  L  L  L  K  H  L  F  Q  K  C  Q  L  I  E  R    345

1441  ATACTTGAAGCCTGGGAAATGAATGAGAAGAAAGAGGCTGAGGGAGAACGGCATGGT   1500
 346   I  L  E  A  W  E  M  N  E  K  K  Q  A  E  G  G  R  R  H  G    365

1501  TACATGGGACACCTAACGAGGATAGCTAACTGTATCGTACAGCACTGACAAGGCCCC  1560
 366   Y  M  G  H  L  T  R  I  A  N  C  I  V  H  S  T  D  K  G  P    385

1561  AACAGTGCATTAGTGCAGCAAGCTTATCAAAGATCTTCCCGACGAAGTCAGGAACGATGG  1620
 386   N  S  A  L  V  Q  Q  L  I  K  D  L  P  D  E  V  R  E  R  W    405

1621  GAGACGTTCTGCACAAGCTCCTTAGGAGAAACTAACAAGAGGAACACGGTAGATCTAGTT  1680
 406   E  T  F  C  T  S  S  L  G  E  T  N  K  R  N  T  V  D  L  V    425

1681  ACAACCTGCCATATTCATTCATCCAGTGATGATGAAATTGACTTTAAAGAAACGGGTTTC  1740
 426   T  T  C  H  I  H  S  S  D  D  E  I  D  F  K  E  T  G  F      445

1741  TCACAGGATTCTTCTTTGCAGCAAGCCTTTTCTGATTATCAGATGCAACAAATGACGTCC  1800
 446   S  Q  D  S  S  L  Q  Q  A  F  S  D  Y  Q  M  Q  Q  M  T  S    465

1801  AATTTTATTGACCAGTTTGGCTTCAACGATGAGAAGTTTGCAGATCAAGATGACGATATTGGC  1860
 466   N  F  I  D  Q  F  G  F  N  D  E  K  F  A  D  Q  D  D  I  G    485
```

FIG. 15C

```
1861  AATGTTTCTTTTGATCGAGTATCAGACATCAACTTTACTCTCAATACAAATGAAAGTGGA  1920
 486   N  V  S  F  D  R  V  S  D  I  N  F  T  L  N  T  N  E  S  G    505

1921  AATATTGCCTTGTTTGAAGCATGTTGTAAGGAAAGAATACAACAGTTTGATGATGGTGGC  1980
 506   N  I  A  L  F  E  A  C  C  K  E  R  I  Q  Q  F  D  D  G  G    525

1981  TCTGATGAGGAAGATATATGGGAGGAAAAGCACATCGCATTCACACCAGAATCCCAAAGA  2040
 526   S  D  E  E  D  I  W  E  E  K  H  I  A  F  T  P  E  S  Q  R    545

2041  CGATCCAGCTCGGGGAGTACAGAGACAGTGAGGAAAGTACAGACTCTGAAGAAGAAGATGGA  2100
 546   R  S  S  G  S  T  D  S  E  E  S  T  D  S  E  E  E  D  G     565

2101  GCAAAGCAAGACTTGTTTGAACCCAGCAGTGCCAACACGGAGCTAAAAATGGAGGTGGAC  2160
 566   A  K  Q  D  L  F  E  P  S  S  A  N  T  E  L  K  M  E  V  D    585

2161  CTGAGTGAACCACCAACTGGTCAGCTAACTTTGATGTCCCAATGGAAACAACCCACGGT  2220
 586   L  S  E  P  P  N  W  S  A  N  F  D  V  P  M  E  T  T  H  G    605

2221  GCTCCATTGGATTCTGTGGGATCTGATGTCTGGAGCACAGAGGAGCCGATGCCAACTAAA  2280
 606   A  P  L  D  S  V  G  S  D  V  W  S  T  E  F  P  M  P  T  K    625

2281  GAGACGGGCTGGGCTTCTTTTTCAGAGTTCACGTCTTCCCTGAGCACAAAAGATTCTTTA  2340
 626   E  T  G  W  A  S  F  S  E  F  T  S  S  L  S  T  K  D  S  L    645

2341  AGGAGTAATTCTCCAGTGGAAATGGAAACCAGCACTGAACCCATGGACCCTCTGACTCCC  2400
 646   R  S  N  S  P  V  E  M  E  T  S  T  E  P  M  D  P  L  T  P    665
```

FIG. 15D

| | | |
|---|---|---|
| 2401 | AGTGCGGGCTGCCCTGGCAGTGCAGGCCAGGAAGCGGCAGTCTGCCATGGAAGCCAGC | 2460 |
| 666 | S A A A L A V Q P E A A G S V A M E A S | 685 |
| 2461 | TCTGACGGAGAGGAGGATGCAGAAAGTACAGACAAGGTAACTGAGACAGTGATGAATGGC | 2520 |
| 686 | S D G E E D A E S T D K V T E T V M N G | 705 |
| 2521 | GGCATGAAGGAAACGCTCAGCCCTCACTGTAGATGCCAAGACAGAGACTGCGGTCTTCAAA | 2580 |
| 706 | G M K E T L S L T V D A K T E T A V F K | 725 |
| 2581 | AGTGAGGAAGGGAAACTGTCTACCTCTCAAGATGCTGCTTGTAAAGACGCAGAGGAGTGT | 2640 |
| 726 | S E E G K L S T S Q D A A C K D A E E C | 745 |
| 2641 | CCCGAGACTGCAGAGGCGAAGTGCGCGGCCCTCCCAGGCCTCCCAGCAGTCCCGAGCAG | 2700 |
| 746 | P E T A E A K C A A P R P P S S P E Q | 765 |
| 2701 | AGGACTGGCCAACCAAGCGCACCAGGTGACACTTCAGTGAATGGCCCTGTATGACGGGTG | 2760 |
| 766 | R T G Q P S A P G D T S V N G P V * | 783 |
| 2761 | ACGTCTGCTGCTGACTGAGGACCGCCAGAACCGCCACTCAGGGGCTCTGGAGGGT | 2820 |
| 2821 | CAGCTGGAGCCCACCAAGCTGTCACTGCTGCACTCTGCAAGGGATCAGGACCAGCA | 2880 |
| 2881 | ACCTTTATATTCTAGATTCTAAGACATTGTACAGAGAAATTCAGAAGTGTAAAAATATTG | 2940 |
| 2941 | CACATTGACAAATACCAAGAATTTTTCCGTATGTTTATATTGTTATTGTTCTAAATAATGG | 3000 |
| 3001 | GTAGCCTGTGAAATAAGATCTTGCCACCCATGTAATAATAGTAGTAATACTATAGTTAAA | 3060 |
| 3061 | ATGGCTGTAAGAATAGTTTTATAAAAGTGAATACACAGATCTATTGTATTTGAAACATAA | 3120 |

FIG. 15E

```
3121  CTTTGACAATTATTAGTGTGACCAAAGTATTAGGCGGTTTTCATACATTTTCACCTTGT  3180
3181  ACAAAATTATGAATTCATTTTCCCTCCAGGCCGACAAGGAGTTGTAGAATGAAAATGCCC  3240
3241  TCTAAGTGTTATTTGGTTGTTCTAACTTACAAAAGTGATTTTGAATAAGAAATATTTGG  3300
3301  TGTTCTTTTTATAACCAGTTTTGATGGTAATTGTTTTTCTGTATTGTTAAAACGGATC  3360
3361  AAAAATGTAAGTCTATTGGTAGAGATTAAGTAAAGTATTTATTGCTACATCATAGTTGAT  3420
3421  AAATTGATGTTATCGTAAAGCCATATGTTCTGTTCAAGTCTTGTTTGCTTGAAATGATTA  3480
3481  TTCCTACAAGTGAAACACTAGACTATTGGAGTGTATATGGCTTGTGTTTTGGGATTTTT  3540
3541  TTTTTTTTTTTGGCTTTTGTTTTGTTTTTTGTTTCTTTTGGTAGTTCATCTG  3600
3601  CCTTTTAACCCATTCACCAAAATTTACCTTGTTAACAAGCATCACCAATGAACATTTCAG  3660
3661  AGCAATCTGCATATTTAACAGACCTAAAATAAATCCTATTAGGCAAGTCAGTTGAAAATG  3720
3721  CTCGTGCTGCTAATGGAATTAGAGTGCGTTCATTTTACAGGCTAGTATTTTAAAAGTAGA  3780
3781  AATCAAAATCTGGCACCGAAGCATGCTAATTGTTTACTGTACCTTGTGAGGTTTTCACTC  3840
3841  ATAAATTTAAACCAGTGTATTTTTAGAACTGGTTGTGTATATATAGTGATTATGG  3900
3901  ATACTAATTCAATGTAATTTATAATTTCTATGTCAATACAAAAATACATCACAGCCTTC  3960
3961  TCAAACAGCTCAAGCAATATATTGTATATTGCCATATCGTCGTGAAAGGGTTAAATTA  4020
```

FIG. 15F

| | | |
|---|---|---|
| 4021 | CTTCACCTCTTGCACTTTTAGATGCAAATCAGTTTTTCATTTCTGTAATAGAAAATTATT | 4080 |
| 4081 | CACGTATTTTACATCATTGTTTTTCCTGACCAGTATTTAAAACCAAAAGGATATTCTG | 4140 |
| 4141 | AAAAATGGCCAACAATTTTTTTAGAAGTAGCATCCCAAGCAGCGGTGCCTAAACATTACAT | 4200 |
| 4201 | TGCATATGGAAATAAAAGAATCAAACGTCTAATGCCTTATTTTTCTGATTTCCTTTTC | 4260 |
| 4261 | ATTTTAAGTGGTGTGGAGATTCCAGCACTCCCAGGACAGTGGAGTCAGCAGTAAGCCCTG | 4320 |
| 4321 | GGACAGGTGGCAAGGGTGGGTGTCCCTTGACCTTTGCACGCCTCCTCAGGAACCCCCTTTCC | 4380 |
| 4381 | CGGGTGAGCCCCTCTCCTGAAGACTGTCCTTGGGCCTCCTCTGGAAGCAGCACCCCCAG | 4440 |
| 4441 | AGGACAGGGCTCCTCCTGCCTTGCCTCTGGTCTCCGCCTGGTCTCGCCTGACTTGAATGGCGTTGGACCTCGG | 4500 |
| 4501 | GGATTACTGGTAGATAATATGCTCCACTGGTCTCCGTGGCACACGTGGCCTCCGTGGTATGGACCTGGTGAGT | 4560 |
| 4561 | CAGGGTTTGGCTCCACTGTGGCCTCTCGTGGTATGGACCTGGTGGCTTCTCCATCCTACCCAAGGTAAC | 4620 |
| 4621 | CATCCCCACTGTGCCTTCATCCCACTGACTGCTGGGAGAGCCCTCTGGGACTTTTCTTTGGGGC | 4680 |
| 4681 | AGTGTCTTGCTTCATCCCACTGACTGCTGGGAGCAGGGAAAGGATATGACAATGGGGAGGACAGTTCTT | 4740 |
| 4741 | ATCATTTGTTTTGTCTTTCGTAGCAGGGAAAGGATATGACAATGGGGAGGACAGTTCTT | 4800 |
| 4801 | TTGGAGGTTGGAGGGCCAAGCCAAGGACAGGAGCAAGTGTGCCCTCATTTGTTTCTAC | 4860 |

FIG. 15G

4861 TTTTAATTTCTGTGTGTGTTGGCCATATACTGAATTATGAGACTAACAGATGTCTACAATACAA 4920
4921 TACCTGTATTCAAAAATAACAAAAATAAAGCCCTGATTCTTTGTTTCTAGAAAAAAAAAAAAA 4980
4981 AAAAAAAAAAAA 4992

FIG. 15H

Zmax7B 5.4kb transcript

```
  1  AGGCCTGCTTGATACGTCCGCGCCTTTTTGGGCGCTTCGCTGATGGTGTGGTGAGCGCGTT   60
 61  TCCCGCCTGAGCGCAACTAGCGGCGGGTCGTGGCCACCTCCAGATAAGAAAACAAGCTCA  120
121  GAGAGATGTGGTGACTTGCTCAAATAGTGACAGAACTTCCTCGGCCATATGGAGGGGTCA  180
181  TATAATACCCTTGTGTCTTCAGTTTGAGGTACCTCCCATAATTTTAAGGGGAGAGCTTGT  240
241  TTCATATCCATATCCCACTGTATTCCTGCTAATCTGCTAATGCAGTAAATTGGAGGAAAA  300
301  CTGTTACCAGGATAACCTGTAATGGGCAAGGAGCCACAAAGAAGAAAACATTTCTTTTAA  360
361  TTTTTAAACTTGGTTTGAAAGACCAGCATGTTTTGGAAATTTGATCTTCACTCATCATCC  420
  1                                   M  F  W  K  F  D  L  H  S  S  S   11
421  CACACATAGACACACTTCTAGAAAGAGAAGATGTAACACTGAAGGAGTTAATGGATGAGGAA  480
 12   H  T  L  L  E  R  E  D  V  T  L  K  E  L  M  D  E  E          31
481  GATGTTTACAGGAATGTAAAGCTCAGAACCGCAAACTTATAGAGTTTCTGTTAAAAGCA  540
 32   D  V  L  Q  E  C  K  A  Q  N  R  K  L  I  E  F  L  L  K  A   51
541  GAATGTCTCGAAGATTTAGTCTCATTCATTATAGAAGAACCACCTCAAGACATGGATGAA  600
 52   E  C  L  E  D  L  V  S  F  I  I  E  E  P  P  Q  D  M  D  E   71
```

FIG. 16A

```
601  AAGATCAGATACAAGTATCCAAATATATCTTGTGAGTTGCTCACTTCTGATGTCTCCCAG   660
 72   K  I  R  Y  K  Y  P  N  I  S  C  E  L  L  T  S  D  V  S  Q    91

661  ATGAATGATAGACTGGGAGAAGATGAATCCTTGCTAATGAAATTATATAGCTTCCTCCTA   720
 92   M  N  D  R  L  G  E  D  E  S  L  L  M  K  L  Y  S  F  L  L   111

721  AACGATTCCCCTTTGAATCCACTACTTGCCAGTTTCTTCAGCAAGGTGCTAAGTATTCTT   780
112   N  D  S  P  L  N  P  L  L  A  S  F  F  S  K  V  L  S  I  L   131

781  ATCAGCAGAAAACCAGAACAGATTGTGGATTTCTTAAAGAAGAAGCATGATTTTGTAGAC   840
132   I  S  R  K  P  E  Q  I  V  D  F  L  K  K  K  H  D  F  V  D   151

841  CTTATTATAAAGCACATAGGAACTTCTGCTATCATGGATTTGTTGCTCAGGCTCCTGACG   900
152   L  I  I  K  H  I  G  T  S  A  I  M  D  L  L  L  R  L  L  T   171

901  TGTATCGAACCTCCACAGCCCAGGCAAGATAGTTCATCCAGGAAGAAGATCGACATTGAATGGT   960
172   C  I  E  P  P  Q  P  R  Q  D  V  L  N  W  I  N  E  E  K  I   191

961  ATCCAGAGGCTTGTGGAAATAGTTCATCCATCGCAAGAAGAAGATCGACATTCAAATGCA  1020
192   I  Q  R  L  V  E  I  V  H  P  S  Q  E  E  D  R  H  S  N  A   211

1021 TCACAATCACTTTGTGAAATTGTTCGCCTGAGCAGAGACCAGATGTTACAAATTCAGAAC  1080
212   S  Q  S  L  C  E  I  V  R  L  S  R  D  Q  M  L  Q  I  Q  N   231

1081 AGTACAGAGCCCGACCCCCTGCTTGCCACTCTAGAAAAGCAAGAAATTATAGAGCAGCTT  1140
232   S  T  E  P  D  P  L  L  A  T  L  E  K  Q  E  I  E  Q  L   251
```

FIG. 16B

```
1141  CTATCAAATATTTCCACAAGGAGAAAATGAGTCAGTGCAATCCAGATA  1200
252    L  S  N  I  F  H  K  E  K  N  E  S  A  I  Q  I     271

1201  TTGCTGACTTTACTTGAGACACGACGACCATTTGAAGGCCATATAGAGATCTGCCCA  1260
272    L  L  T  L  L  E  T  R  R  P  T  F  E  G  H  I  E  I  C  P     291

1261  CCAGGCATGAGCCATTCAGTCTTGTTCAGTAAACAAGAGTGTTCTAGAAGCCATCAGAGGA  1320
292    P  G  M  S  H  S  A  C  S  V  N  K  S  V  L  E  A  I  R  G     311

1321  AGACTTGGATCTTTTCATGAACTCCTGCTGGAGCCACCCAAGAAAAGTGTGATGAAGACC  1380
312    R  L  G  S  F  H  E  L  L  L  E  P  P  K  K  S  V  M  K  T     331

1381  ACATGGGGTGTGCTGGATCCTCCTGTGGGAATACCCGGTTGAATGTCATTAGTTGATA  1440
332    T  W  G  V  L  D  P  P  V  G  N  T  R  L  N  V  I  R  L  I     351

1441  TCCAGCCTGCTTCAAACCAATACCAGCAGTATAAATGGGACCTTATGGAGCTGAATAGC  1500
352    S  S  L  Q  T  N  T  S  S  I  N  G  D  L  M  E  L  N  S     371

1501  ATTGGAGTCATATATTGAACATGTTCTTCAAGTATACATGGAATAACTTTTTGCATACACAA  1560
372    I  G  V  I  L  N  M  F  F  K  Y  T  W  N  N  F  L  H  T  Q     391

1561  GTGGAAATTTGTATTGCACTGATTCTTGCAAGTCCTTTTGAAAACACAGAAAATGCCACA  1620
392    V  E  I  C  I  A  L  I  L  A  S  P  F  E  N  T  E  N  A  T     411

1621  ATTACCGATCAAGACTCCACTGGTGATAATTTGTTATTAAAACATCTTTTCCAAAAATGT  1680
412    I  T  D  Q  D  S  T  G  D  N  L  L  L  K  H  L  F  Q  K  C     431
```

FIG. 16C

```
1681  CAATTAATAGAACGAATACTTGAAGCCTGGGAAATGAATGAGAAGAAACAGGCTGAGGGA  1740
 432   Q  L  I  E  R  I  L  E  A  W  E  M  N  E  K  K  Q  A  E  G   451

1741  GGAAGACGGCATGGTTACATGGGACACCTAACGAGGATAGCTAACTGTATCGTGCACAGC  1800
 452   G  R  R  H  G  Y  M  G  H  L  T  R  I  A  N  C  I  V  H  S   471

1801  ACTGACAAGGGCCCCAACAGTGCATTAGTGCAGCAGTCATTCAAAGATCTTCCGACGAA   1860
 472   T  D  K  G  P  N  S  A  L  V  Q  Q  L  I  K  D  L  P  D  E   491

1861  GTCAGGGAACGATGGGAGAGCGTTCTGCACAAGCTCCTTAGGAGAAACTAACAAGAGGAAC  1920
 492   V  R  E  R  W  E  T  F  C  T  S  S  L  G  E  T  N  K  R  N   511

1921  ACGGTAGATCTAGCCTTTTCTGATTATCAGATGCAACAAATGACGTCCAATTTTATTGAC  1980
 512   T  V  D  L  A  F  S  D  Y  Q  M  Q  Q  M  T  S  N  F  I  D   531

1981  CAGTTTGGCTTCAACGATGAGAAGTTTGCAGATCAAGATGACATTGGCAATGTTTCTTTT  2040
 532   Q  F  G  F  N  D  E  K  F  A  D  Q  D  D  I  G  N  V  S  F   551

2041  GATCGAGTATCAGACATCAACTTTACTCTCAATACAAATGAAAGTGGAAATATTGCCTTG  2100
 552   D  R  V  S  D  I  N  F  T  L  N  T  N  E  S  G  N  I  A  L   571

2101  TTTGAAGCATGTTGTAAGGAAAGAATACAACAGTTTGATGATGGTGGCTCTGATGAGGAA  2160
 572   F  E  A  C  C  K  E  R  I  Q  Q  F  D  D  G  G  S  D  E  E   591

2161  GATATATGGGAGGAAAAGCACATCGCATTCACACCAGAATCCCAAAGACGATCCAGCTCG  2220
 592   D  I  W  E  E  K  H  I  A  F  T  P  E  S  Q  R  R  S  S  S   611
```

FIG. 16D

```
2221  GGGAGTACAGACAGTGAGGAGGAAAGTACAGACTCTGAAGAAGAAGATGGAGCAAAGCAAGAC  2280
612    G  S  T  D  S  E  E  S  T  D  S  E  E  E  D  G  A  K  Q  D     631

2281  TTGTTTGAACCCAGCAGTGCCAATGAAACGGAGGATAAATGGAGGTGGACCTGAGTCAACCA  2340
632    L  F  E  P  S  A  N  T  E  D  K  M  E  V  D  L  S  E  P        651

2341  CCCAACTGGTCAGCTAACTTTGATGTCCCAATGGAAACAACCCACGGTGCTCCATTGGAT   2400
652    P  N  W  S  A  N  F  D  V  P  M  E  T  T  H  G  A  P  L  D     671

2401  TCTGTGGGATCTGATGTCTGGAGCACAGAGGAGCCGATGCCAACTAAAGAGACGGGCTGG    2460
672    S  V  G  S  D  V  W  S  T  E  E  P  M  P  T  K  E  T  G  W     691

2461  GCTTCTTTTTCAGAGTTCACGTCTTCCCTGAGCACAAAAGATTCTTTAAGGAGTAATTCT    2520
692    A  S  F  S  E  F  T  S  S  L  S  T  K  D  S  L  R  S  N  S     711

2521  CCAGTGGAAATGGAAACCAGCACTGAACCCATGGACCCTCTGACTCCCAGTGCGCTGCC    2580
712    P  V  E  M  E  T  S  T  E  P  M  D  P  L  T  P  S  A  A  A     731

2581  CTGGCAGTGCAGCCAGAAGCGGCAGGCAGTGTGGCCATGGAAGCCAGTCTGACGGAGAG    2640
732    L  A  V  Q  P  E  A  A  G  S  V  A  M  E  A  S  S  D  G  E     751

2641  GAGGATGCAGAAAGTACAGACAAGGTAACTGAGACAGTGATGAATGGCGGCATGAAGGAA   2700
752    E  D  A  E  S  T  D  K  V  T  E  T  V  M  N  G  G  M  K  E     771

2701  ACGCTCAGCCTCACTGTAGATGCCAAGACAGAGACTGCGGTCTTCAAAAGGTTCTTTGAC   2760
772    T  L  S  L  T  V  D  A  K  T  E  T  A  V  F  K  R  F  F  D     791
```

FIG. 16E

```
2761  ACCTTCACCGAGTCTGCAGTTTGCTTACGTGCAGTCGTGGACATATATTCCCCAAAT  2820
 792   T  F  T  E  S  A  V  L  L  T  C  S  R  G  H  I  I  P  P  N   811
2821  TCCTCATTTCTAGGAGTATTCTGAAACTCTGTACATTTCTTTTCTGTTTTGCACACTG  2880
 812   S  S  F  L  G  V  F  *                                         819
2881  GGCTTCAGAGTGTTGAAATCCTATCGTGAGGAAGGGAAACTGTCTACCTCTCAAGATGCT  2940
2941  GCTTGTAAAGACGCAGAGGAGTGTCCCGAGACTGCAGAGGCGAAGTGCGGGGCCCAGG    3000
3001  CCTCCCCAGCAGTCCCGAGCAGGACTGGCCAACCAAGCCCACCAGTGACACTTCA       3060
3061  GTGAATGGCCCTGTATGACGGGTGACGTCTCTGCTGCTGAGGACTGCAGACCGCC       3120
3121  ACCACTCAGGGGCTCTGGAGGGTCAGCTGGAGCCCACCAAGCTGTCACTGCTGCACTCA   3180
3181  CTCTGCAAGGGATCAGGACCAACCTTTATATTCTAGATTCTAAGACATTGTACAGAG     3240
3241  AAATTCAGAAGTGTAAAAATATTGCACATTGACAAATACCAAGAATTTTTGCGTATGTTT 3300
3301  ATATTGTATTGTTCTAAATAATGGGTAGCCTGTGAAATAAGATCTTGCCACCCATGTAAT 3360
3361  AATAGTAGTAATACTATAGTTAAAAATGGCTGTAAGAATAGTTTTATAAAAGTGAATACAC 3420
3421  AGATCTATTGTATTTGAAACATAACTTTGACAATTATTAGTGTGACCAAAGTATTAGGCG 3480
```

FIG. 16F

```
3481  GTTTTCATACATTTTCACCTTGTACAAAATTATGAATTCATTTTTCCTCCAGGCCGACA  3540
3541  AGGAGTTGTAGAATGAAAATGCCCTCTAAGTGTTATTTGGTTGTTCTAACTTACAAAAG  3600
3601  TGATTTTGAATAAGAAATATTGGTGTGTTCTTTTTTATAACCAGTTTTTGATTGGTAATTGT  3660
3661  TTTCTGTATTGTTTAAAACGGATCAAAAATGTAAGTCTATTGGTAGAGATTAAGTAAAGT  3720
3721  ATTTATTGCTACACATCATAGTTGATAAATTGATGTTATCGTAAAGCCATATGTTCTGTTCA  3780
3781  AGTCTTGTTTGCTTGAAATGATTATTCCTACAAGTGAAAACACTAGACTATTTGGAGTGTA  3840
3841  TATGGCTTGTGTTTTGGGATTTTTTTTTTTTTGCTTTTGTTTTGTTTTT  3900
3901  TTGTTTCTTTTTGGTAGTTCATCTGCCTTTTAACCCATTCACCAAAATTTACCTTGTTAAC  3960
3961  AAGCATCACCAATGAACATTTCAGAGCAATCTGCATATTTAACAGACCTAAAATAAATCC  4020
4021  TATTAGGCAAGTCAGTTGAAAATGCTCGTGCTGCTAATGGAATTAGAGTGCGTTCATTTT  4080
4081  ACAGGCTAGTATTTTAAAAGTAGAAATCAAAATCTGGCACCGAAGCATGCTAATTGTTTA  4140
4141  CTGTACCTTGTGAGGTTTTCACTCATAAATTTAAACCAGTGTATTTTTTAGAACTGGTT  4200
4201  TGTGTATATATATAGTGATTATGGATACTAATTCAATGTAATTTATAATTTTCTATGTCA  4260
```

FIG. 16G

```
4261  ATACAAAAATACATCACAGCCCTTCTCAAACAGCTCAAGCAATATATTGTATATTGCCATA  4320
4321  TCGTCTGGTGAAAGGGTTAAATTACTTCACCTCTTGCACTTTTAGATGCAAATCAGTTTT  4380
4381  TCATTTCTGTAATAGAAAAATTATTCACGTATTTTACATCATTGTTTTTCCTGACCAGT  4440
4441  ATTTAAAACCAAAAGGATATTCTGAAAAATGGCCAACAATTTTTTAGAAGTAGCATCCC  4500
4501  AAGCAGCGTGCCTAAACATTACATTGCATATGGAAATAAAAGAATCAAACGTCTAATGCC  4560
4561  TTATTTTTCTGATTTCCTTTTTCATTTTAAGTGGTGTGGAGATTCCAGCACTCCCAGGA  4620
4621  CAGTGGAGTCAGCAGTAAGCCCTGGGACAGGTGGCAAGGGTGGGTCCCTTGACCTTTGCA  4680
4681  CGCCTCCTCAGGAACCCCCTTTCCCGGGTGAGCCCCTCTGAAGAGACTGTCCTTGGGC  4740
4741  CTCCTCTGGAAGCAGCACCCCAGAGGAGGACTCGGGGATTACTGGTAGATAATATGCTCTGGTCTCGCCTG  4800
4801  GACTTGAATGGCGTTGGACCTGGTGGCTTCTCCAGCCATGGCCAGGGTTTGGCTCCACTGGTGGCACACGTGGCCTGCCTG  4860
4861  GTGGTGAGTTTTGCCAGCCATGGCCAGGGTTTGGCTCCACTGGTGGCCCTCTGGTATGGACCTGGTGG  4920
4921  GTGGTATGGACCTGGTGGCTTCTCCATCCTGGCCCTCTGTGTATGGACCTGGTGG  4980
4981  CTTCTCCATCCTACCCAAGGTAACAGTGTCTTGCTTCATCCCACTGACTGCTGGGAGAGA  5040
```

FIG. 16H

```
5041  GCCTCTGGGACTTTTCTTTGGGGCATCATTTGTTTTGTCTTTCGTAGCAGGGAAAGGAT  5100
5101  ATGACAAATGGGGAGGACAGTTCTTTTGGAGGTTGGAGGGCCAAGCCAAGGACAGGAGCA  5160
5161  AGTGTGCCCTCATTTTGTTTCTACTTTTAATTCTGTGTGTTGGCCATACTGAATTATGA  5220
5221  GACTAACAGATGTCTACAATACAATACCTGTATTCAAAATAACAAAAATAAAGCCTGATT  5280
5281  CTTTGTTTCTAGAAAAAAAAAAAAAAAAAAAAAAA  5316
```

FIG. 16I

Zmax8A

```
   1 GGGGCGATGAGGTGAGGACGCCCGGGAACCCGGAGGCACCGCGGGCGCACCCGGAGGCCGAGGGCCACGGACCTG      60
  61 GGACGCGGAGTCCTGAAGCGGCCGGCGGGACGGTTTCGTACGGCGGCCGTGCGGAGGCGAG                   120
 121 GAGAGAACATTGAAAGTATTCTCTAAGCTATTTGAAGCTGACTGACTAAATGCACTGGGT                    180
 181 CAGGCTGTCTGTGGGTATGAAGTGGTTGGGAGAATCCAAGAACATGGTGGTGAATGGCAG                    240
   1                 M   K   W   L   G   E   S   K   N   M   V   V   N   G   R      15
 241 GAGAAATGGAGGCAAGTTGTCTAATGACCATCAGCAGAATCAAATTACAGCACAC                        300
  16  R   N   G   G   K   L   S   N   D   H   Q   Q   N   Q   S   K   L   Q   H   T   35
 301 GGGGAAGGACACCCTGAAGGCTGGCAAAAATGCAGTCGAGAGGAGTCGAACAGATGTAA                    360
  36  G   K   D   T   L   K   A   G   K   N   A   V   E   R   R   S   N   R   C   N   55
 361 TGGTAACTCGGGGATTTGAAGGACAGAGTCGCTATGTACCATCCTCTGGAATGTCCGCCAA                  420
  56  G   N   S   G   F   E   G   Q   S   R   Y   V   P   S   S   G   M   S   A   K   75
 421 GGAACTCTGTGAAAATGATGACCTAGCAACCAGTTTGGTTCTTGATCCCTATTTAGGTTT                   480
  76  E   L   C   E   N   D   D   L   A   T   S   L   V   L   D   P   Y   L   G   F   95
 481 TCAAACACACAAAATGAATACTAGCGCCTTTCCTTCCTGTGAGAGTCAAGGCATTTTTCAAA                 540
  96  Q   T   H   K   M   N   T   S   A   F   P   S   R   S   S   R   H   F   S   K   115
 541 ATCTGACAGTTTTTCTCACAACCCTGTGAGATTTAGGCCTATTAAGGAAGGCAGGA                       600
 116  I   L   T   V   F   L   H   N   P   V   R   F   R   P   I   K   G   R   Q   E   135
 601 AGAACTAAAGGAAGTAATTGAACGTTTTAAGAAAGATGAACACTTGGAGAAAGCCTTCAA                   660
 136  E   L   K   E   V   I   E   R   F   K   K   D   E   H   L   E   K   A   F   K   155
 661 ATGTTTGACTTCAGGCGAATGGGCACGGCACTATTTATTTCTCAACAAGAATAAAATGCAGGA                720
 156  C   L   T   S   G   E   W   A   R   H   Y   F   L   N   K   N   K   M   Q   E   175
 721 GAAATTATTCAAAGAACATGTATTTATTTATTTGCGAATGTTTGCAACTGACAGTGGATT                   780
 176  K   L   F   K   E   H   V   F   I   Y   L   R   M   F   A   T   D   S   G   F   195
 781 TGAAATATTGCCATGTAATAGATACTCATCAGAACAAAATGGAGCCAAAATAGTTGCAAC                   840
 196  E   I   L   P   C   N   R   Y   S   S   E   Q   N   G   A   K   I   V   A   T   215
 841 AAAAGAGTGGAAACGAAATGACAAATTACTGGTGGGTTGTATTGCCGAACTTTC                         900
 216  K   E   W   K   R   N   D   K   I   E   L   L   V   G   C   I   A   E   L   S   235
 901 AGAAATTGAGGAGAACATGCTACTTAGACATGGAGAAAAACGACTCAGTGTCATGTACTC                   960
```

FIG. 17A

```
 236  E  I  E  E  N  M  L  L  R  H  G  E  N  D  F  S  V  M  Y  S    255
 961 CACAAGGAAAAACTGTGCTCAACTCTGGCTGGGTCCTGCGTTTATAAACCATGATTG       1020
 256  T  R  K  N  C  A  Q  L  W  L  G  P  A  A  F  I  N  H  D  C    275
1021 CAGACCTAATTGTAAGTTTGTGTCAACTGGTCGAGATACAGCATGTGAAGGCTCTAAG       1080
 276  R  P  N  C  K  F  V  S  T  G  R  D  T  A  C  V  K  A  L  R    295
1081 AGACATTGAACCTGGAGAAGAAATTTCTTGTTATTATGGAGATGGGTTCTTTGGAGAAAA    1140
 296  D  I  E  P  G  E  E  I  S  C  Y  Y  G  D  G  F  F  G  E  N    315
1141 TAATGAGTTCTGCGAGTGTTACACTTGCGAAAGACGGGGCACTGGTGCTTTTAAATCCAG    1200
 316  N  E  F  C  E  C  Y  T  C  E  R  R  G  T  G  A  F  K  S  R    335
1201 AGTGGGACTGCCCTGCGCCCTGTTAATAGGCTTAAAAAGTTAGGTGACAGCAGACAAGA    1260
 336  V  G  L  P  A  P  A  P  V  I  N  S  K  Y  G  L  R  E  T  D    355
1261 TAAACGTTTAAATAGGCTTAAAAAGTTAGGTGACACCACTCAGGAACAATGCAACTTCTAACCG    1320
 356  K  R  L  N  R  L  K  K  L  G  D  S  S  K  N  S  D  S  Q  S    375
1321 TGTCAGCTCTAACACTGATGCAGATACCACTCAGGAAAAAACAATGCAACTTCTAACCG    1380
 376  V  S  S  N  T  D  A  D  T  T  Q  E  K  N  N  A  T  S  N  R    395
1381 AAAATCTTCAGTTGGCGTAAAAAGAATAGCAAGCAGAACGTTAACGAGGCAATCTAT       1440
 396  K  S  S  V  G  V  K  K  N  S  K  S  R  T  L  T  R  Q  S  M    415
1441 GTCAAGAATTCCAGCTTCTTCCAACTCTAAGCTAACTTCATCTATAAATAATTC          1500
 416  S  R  I  P  A  S  S  N  S  T  S  S  K  L  T  H  I  N  N  S    435
1501 CAGGGTACCAAGAAACTGAAGAAGCCTGCAAAGCCTTTACTTTCAAAGATAAAATTGAG    1560
 436  R  V  P  K  L  K  K  P  A  K  P  L  L  S  K  I  K  L  L  R    455
1561 AAATCATTGCAAGCGGCTGGAGCAAAAGAATGCTTCAAGAAAACTCGAAATGGGAAACTT    1620
 456  N  H  C  K  R  L  E  Q  K  N  A  S  R  K  L  E  M  G  N  L    475
1621 AGTACTGAAAGAGCCTAAAGTAGTTCTGTATAAAAATTGCCCATTAAAAAAGATAAGGA    1680
 476  V  L  K  E  P  K  V  L  Y  K  N  L  P  I  K  K  D  K  E      495
1681 GCCAGAGGGACCAGCCCAAGCCGCAGTTGCCAGGTGCTTGACTAGACACGCGGGCGAG       1740
 496  P  E  G  P  A  Q  A  A  V  S  G  C  L  T  R  H  A  A  R      515
1741 AGAACACAGAATCCTGTGAGGACAAGAACAAATCTGAAGGAGGCCTCGCCCTGCAC          1800
 516  E  H  R  Q  N  P  V  R  G  A  H  S  Q  E  S  P  C  T           535
1801 CTACATAACTCGGCGGTCAGTGAGGACAAGAACAAATCTGAAGGAGGCCTCTGACATCAA    1860
```

FIG. 17B

```
         Y  I  T  R  R  S  V  R  T  R  T  N  L  K  E  A  S  D  I  K            555
1861   GCTTGAACCAATACGTTGAAATGGCTATAAAGCAGTGTGACGGAACCTTGCCCGACAG              1920
         L  E  P  N  T  L  N  G  Y  K  S  S  V  T  E  P  C  P  D  S            575
1921   TGGTGAACAGCTGCAGCCAGCTCCTGTGCTGCAGGAGGAACTGGCTCATGAGACTGC              1980
         G  E  Q  L  Q  P  A  P  V  L  Q  E  E  E  L  A  H  E  T  A            595
1981   ACAAAAAGGGGAGGCAAAGTGTCATAAGAGTGTCAAAAATAGAGTGCATGTCAAAAAGAAGTCACG      2040
         Q  K  G  E  A  K  C  H  K  S  D  T  G  M  S  K  K  K  S  R            615
2041   ACAAGGAAAACTTGTGAAACAGTTTGCAAAAATACAGTTACTCCAGTGCACGATTC                2100
         Q  G  K  L  V  K  Q  F  A  K  I  E  E  S  T  P  V  H  D  S            635
2101   TCCTGGAAAAGACGACGCGGTACCAGATTTGATGGGTCCCCATTCTGACCAGGGTGAGCA           2160
         P  G  K  D  D  A  V  P  D  L  M  G  P  H  S  D  Q  G  E  H            655
2161   CAGTGGCACTGTGGGCGTGCCTGTGAGCTACACAGACTGTGCTCCTCACCCGTCGGTTG             2220
         S  G  T  V  G  V  P  V  S  Y  T  D  C  A  P  S  P  V  G  C            675
2221   TTCAGTTGTGACATCAGATAGCTTCAAAAGACAAAGACAGCTTTAGAACTGCAAAAAGTAA          2280
         S  V  T  S  D  S  F  K  T  K  D  S  F  R  T  A  K  S  K              695
2281   AAAGAAGAGGCGAATCACAAGTATGATGCACAGTTAATCCTAGAAAATAACTCTGGGAT            2340
         K  K  R  I  T  R  Y  D  A  Q  L  I  E  N  N  S  G  I                  715
2341   TCCCAAATTGACTCTTCGTAGGCGTCATGATAGCAGCAGCAAAATGACAAGAGAA                 2400
         P  K  L  T  L  R  R  H  D  S  S  K  T  N  D  Q  E  N                  735
2401   TGATGGAATGAACTCTTCCAAAATAAGCATCAAGTTAAGCAAAGACCATGACAACGATAA           2460
         D  G  M  N  S  S  K  I  S  I  K  L  S  K  D  H  D  N  D  N            755
2461   CAATCTCTATGTGTAGCAAAGCTTAACTCAGGATCAGGATCAGGCAGTAGTTCTAC                2520
         N  L  Y  V  A  K  L  N  N  G  F  N  S  G  S  G  S  S  T              775
2521   AAAATTAAAAAATCCAGCTAAAACGAGAAATAGGGGTCTTATACAGAGAGGGCT                  2580
         K  L  I  Q  L  K  R  D  E  E  N  R  G  S  Y  T  E  G  L              795
2581   TCATGAAAATGGGGGTGTGCTGCAGTGATCCTCTTTCTCTTGGAGTCTCGAATGGAGGT             2640
         H  E  N  G  V  C  C  S  D  P  L  S  L  L  E  S  R  M  E  V            815
2641   GGATGACTATAGTCAGTATGAGGAAGAAAGTACAGATGATTCCTCCTCTTCCTGAGGGCGA           2700
         D  D  Y  S  Q  Y  E  E  E  S  T  D  D  S  S  S  E  G  D              835
2701   TGAAGAGGAGGATGACTATGATGATGACTTTGAAGACGATTTTATTCCTCTTCCTCCAGC            2760
```

FIG. 17C

```
836                 E   E   D   D   Y   D   D   D   F   E   D   D   F   I   P   L   P   P   A              855
2761  TAAGCGCTTGAGGTTAATAGTTGGAAAAGACTCTATAGATATTGACATTCTTCAAGGAG    2820
856                 K   R   L   I   V   G   K   D   S   I   D   I   D   I   S   R   R              875
2821  AAGAGAAGATCAGTCTTTAAGGCTTAATGCCTAAGCTCTTGGTCTTAACTTGACCTGGGA    2880
876                 R   E   D   Q   S   L   R   L   N   A   *                                       886
2881  TAACTACTTTAAAGAATAAAAATTCCAGTCAATTATTCCTCAACTGAAAGTTTAGTGG      2940
2941  CAGCACTTCTATTGTCCCTTCACTTATCGCAAATTTGTGCAAATTGTACAGCATACT       3000
3001  GACTCAATTCTTAAGTCTGATTGTGAGAGTAAAGCCCCTGTTAAATAGCCTTCTT         3060
3061  ACGTGCAATTCTGAGTTAGAGCAACTTTCCACACAGGACGTTGTAAAATAAAGGCTCAAGCAATAGTCCAAAATTG  3120
3121  TACAGTGATAGACAACTTTCCACACAGGACGTTGTAAAATAAAGGCTCAAGCAATAGTCCAAAATTG           3180
3181  TTTAACTGTAAGAGCATCAGCATTAAGGTTTCTAGTATGTAATATATGACTAAACATTAAAACAA             3240
3241  ATCATAGTAGCAGCATATTTGCTAGATGTTTCCCCCTTGGAGTTTTGTCAGTTTCACTGTTT                3300
3301  GCTTTTTGATTTATTGCTAGATGTTTCCCCCTTGGAGTTTTGTCAGTTTCACACTGTTT                   3360
3361  GCTGGCCCAGGTGTACTGTTTGTGGCCCTTTGTTAATATCGCAAACCATTGGTTGGGAGTC                 3420
3421  AGATTGGTTTCTT    3433
```

FIG. 17D

Zmax8B

```
  1 GGGGCGATGAGGTGAGGACGCCCGGGAACCGGAGGCACCGCGCGGCACCGGAGGCACGGACCTG           60
 61 GGACGCGGAGTCCTGAAAGCCGGACGGTTTTCGTACGGGCGGCCGTGCCGTGCCGAGGCGAG          120
121 GAGAGAACATTGAAAGTATTCTCAAGCTATTTGAAGAGAGTGACTAAATGCACCTGGGT             180
181 CAGGCTGTCTGTGGGTATGAAGTGGTTGGGAGAATCCAAGAACATGGTGGTGAATGGCAG           240
  1                             M   K   W   L   G   E   S   K   N   M   V   V   N   G   R              15
241 GAGAAATGGAGGCAAGTTGTCTAATGACCAGCAGAATCAATCAAAATTACAGCACAC              300
 16  R   N   G   G   K   L   S   N   D   Q   Q   N   Q   S   K   L   Q   H   T                            35
301 GGGGAAGGACACCCTGAAGGCTGGCAAAAATGCAGTCGAGAGGAGGTCGAACAGATGTAA           360
 36  G   K   D   T   L   K   A   G   K   N   A   V   E   R   R   S   N   R   C   N                        55
361 TGGTAACTCGGGATTTGAAGGACAGAGTCGCTATGTACCATCCTCTGGAATGTCCGCCAA           420
 56  G   N   S   G   F   E   G   Q   S   R   Y   V   P   S   S   G   M   S   A   K                        75
421 GGAACTCTGTGAAATGATGACCTAGCAACCAGTTTGGTTCTTGATCCCTATTTAGGTTT            480
 76  E   L   C   E   N   D   D   L   A   T   S   L   V   L   D   P   Y   L   G   F                        95
481 TCAAACACACACAAATGAATACTAGCGCCTTTCCTTCGAGGAGCTCAAGGCATTTTTCAAA          540
 96  Q   T   H   K   M   N   T   S   A   F   P   S   R   S   S   R   H   F   S   K                       115
541 ATCTGACAGTTTTTCCACAACCCTGTGAGATTTAGGCCTATTAAGGAAGGCAGGA              600
116  S   D   S   F   S   H   N   N   P   V   R   F   R   P   I   K   G   R   Q   E                       135
601 AGAACTAAAGGAAGTAATTGAACGTTTTAAGAAGATGAACACTTGGAGAAAGCCTTCAA            660
136  E   L   K   E   V   I   E   R   F   K   K   D   E   H   L   E   K   A   F   K                       155
661 ATGTTTGACTTCAGGCGAATGGGCACGGCACTATTTCTCAACAAGAATAAAATGCAGGA            720
156  C   L   T   S   G   E   W   A   R   H   Y   F   L   N   K   N   K   M   Q   E                       175
721 GAAATTATTCAAAGAACATGTATTTATTTATTTGCGAATGTTTGCAACTGACAGTGGATT          780
176  K   L   F   K   E   H   V   F   I   Y   L   R   M   F   A   T   D   S   G   F                       195
781 TGAAATATTGCCATGTAATAGACTAATCATCAGAACAAATAGTTGCAAC                840
196  E   I   L   P   C   N   R   Y   S   S   E   Q   N   G   A   K   I   V   A   T                       215
841 AAAAGAGTGGAAACGAAAATGACAAATAGAATTACTGGTGGTTGTATTGCCGAACTTTC          900
```

FIG. 18A

```
216  K  E  W  K  R  N  D  K  I  E  L  L  V  G  C  I  A  E  L  S
901  AGAAATTGAGGAGAACATGCTACTTAGACATGGAGAGAACGACTTCAGTGTCATGTACTC   960
236  E  I  E  E  N  M  L  R  H  G  E  N  D  F  S  V  M  Y  S
961  CACAAGGAAAAACTGTGCTCAACTCTGGCTGCGTTATAAACCATGATTG              1020
256  T  R  K  N  C  A  Q  L  W  L  G  P  A  A  F  I  N  H  D  C
1021 CAGACCTAATTGTGTAAGTTTGTGTCAACTGGTCGAGATACAGCATGTGAAGGCTCTAAG  1080
276  R  P  N  C  K  F  V  S  T  G  R  D  T  A  C  V  K  A  L  R
1081 AGACATTGAACCTGGAGAAGAAATTTCTTGTTATTATGGAGATGGGTTCTTTGGAGAAAA  1140
296  D  I  E  P  G  E  E  I  S  C  Y  Y  G  D  G  F  F  G  E  N
1141 TAATGAGTTCTGCGAGTGTTACACTTGCGAAAGACGGGGCACTGGTGCTTTTAAATCCAG  1200
316  N  E  F  C  E  C  Y  T  C  E  R  R  G  T  G  A  F  K  S  R
1201 AGTGGGACTGCCTGCGCCCTGTTGCTCCTGTTATCAATAGCAAATATGGACTCAGAGAAACAGA  1260
336  V  G  L  P  A  P  V  I  N  S  K  Y  G  L  R  E  T  D
1261 TAAACGTTTAAATAGGCTTAAAAAAGTTAGGTGACAGCAGCAAAAATTCAGACAGTCAATC  1320
356  K  R  L  N  R  L  K  K  L  G  D  S  K  N  S  D  S  Q  S
1321 TGTCAGCTCTAACACTGATGCAGATACCACTCAGGAAAAAGAACGTTAACGAGGCAATCTAT  1380
376  V  S  S  N  T  D  A  D  T  T  Q  E  K  N  N  A  T  S  N  R
1381 AAAATCTTCAGTTGGCGTAAAAAAGAATAGCAAGAGCCAGAACGTTAACGAGGCAATCTAT  1440
396  K  S  S  V  G  V  K  K  N  S  K  S  R  T  L  T  R  Q  S  M
1441 GTCAAGAATTCCAGCTTCTTCCAAACTCTACCTCATCTAAGCTAACTACTTCATATAATTC  1500
416  S  R  I  P  A  S  S  N  S  T  S  S  K  L  T  H  I  N  N  S
1501 CAGGGTACCAAAGAACTGAAGAAGCCTGCAAAGCCCTTTACTTTCAAAGATAAAATTGAG  1560
436  R  V  P  K  K  L  K  K  P  A  K  P  L  L  S  K  I  K  L  R
1561 AAATCATTGCAAGCGGCTGGAGCAAAGAATGCTTCAAGAAACTGAAATGGGAAACTT  1620
456  N  H  C  K  R  L  E  Q  K  N  A  S  R  K  L  E  M  G  N  L
1621 AGTACTGAAAGAGCCTAAAGTTCTGTATAAAAATTGCCCATTAAAAAGATAAGGA       1680
476  V  L  K  E  P  K  V  V  L  Y  K  N  L  P  I  K  K  D  K  E
1681 GCCAGAGGGACCAGCCCAAGCTGTGCCAGTTGACTAGACACGCGGCGAG             1740
```

FIG. 18B

```
          P   E   G   P   A   Q   A   A   V   A   S   G   C   L   T   R   H   A   A   R       515
 496  AGAACACAGAGAATCCTGTGAGAGGTGTGCTCATTCGCAGGGGGAGAGCTCGCCCTGCAC                              1800
          E   H   R   Q   N   P   V   R   G   A   H   S   Q   G   E   S   S   P   C   T       535
1741  CTACATAACTCGGCGGTCAGTGAGGACAAGAACAAATCTGAAGGAGGCCTCTGACATCAA                              1860
          Y   I   T   R   R   S   V   R   T   R   T   N   L   K   E   A   S   D   I   K       555
1801  GCTTGAACCAATACGTTGAATGGCTATAAAGCAGTGTGACGAACCTGTGCCCGACAG                                 1920
          L   E   P   N   T   L   N   G   Y   K   S   V   T   E   P   C   P   D   S           575
1861  TGGTGAACAGCTGCAGCCAGCTCCTGTGCTGCAGGAGGAACTGGCTCATGAGACTGC                                 1980
          G   E   Q   L   Q   P   A   P   V   L   Q   E   E   E   L   A   H   E   T   A       595
1921  ACAAAAGGGGAGGCAAAGTGTCATAAGAGTGACACAGGCATGTCCAAAAAGAAGTCACG                               2040
          Q   K   G   E   A   K   C   H   K   S   D   T   G   M   S   K   K   K   S   R       615
1981  ACAAGGAAAAACTTGTGAAACAGTTTGCAAAAATACAGAGGAATCTACTCCAGTGCACGATTC                           2100
          Q   G   K   L   V   K   Q   F   A   K   I   E   S   T   P   V   H   D   S           635
2041  TCCTGGAAAAGACGACGCGGTACCAGATTTGATGGGTCCCCATTCTGACCAGGTGAGCA                               2160
          P   G   K   D   D   A   V   P   D   L   M   G   P   H   S   D   Q   G   E   H       655
2101  CAGTGGCACTGTGTGGGCACTGTGGCCTACACAGACTGTGCTCCTTCACCCGTCGGTTG                               2220
          S   G   T   V   G   V   P   V   S   Y   T   D   C   A   P   S   P   V   G   C       675
2161  TTCAGTTGTGTGACATCAGATAGCTTCAAAACAAAAGACAGCTTTAGAACTGCAAAAAGTAA                            2280
          S   V   V   T   S   D   S   F   K   T   K   D   S   F   R   T   A   K   S   K       695
2221  AAAGAAGAGGCGAATCACAAGGTATGATGCACAGTTAATCCTAGAAAATAACTCTGGGAT                              2340
          K   K   R   R   I   T   R   Y   D   A   Q   L   I   L   E   N   N   S   G   I       715
2281  TCCCAAATTGACTCTTCGTAGCCGTCATGATAGCAGCAAAACAAATGACCAAGAGAA                                 2400
          P   K   L   T   L   R   R   H   D   S   S   K   T   N   D   Q   E   N               735
2341  TGATGGAATGAACTCTTCCAAAATAAGCATCAAGTTAAGCAAAGACCATGACAACGATAA                              2460
          D   G   M   N   S   S   K   I   S   I   K   L   S   K   D   H   D   N   D   N       755
2401  CAATCTCTATGTAGCAAAGCTTAATAATGGATTTAACTCAGGATCAGGCAGTAGTTCTAC                              2520
          N   L   Y   V   A   K   L   N   N   G   F   N   S   G   S   G   S   S   T           775
2461  AAAATTAAAAATCCAGTGAGGATGAGGAAAATAGGGGGTCTTATACAGAGGGCT                                    2580
```

FIG. 18C

```
776        K  L  K  I  Q  L  K  R  D  E  E  N  R  G  S  Y  T  E  G  L                              795
2581  TCATGAAAAATGGGGTGTGCTGCAGTGATCCTCTTCTCTTGGAGTCTCGAATGGAGGT                                   2640
796        H  E  N  G  V  C  C  S  D  P  L  S  L  L  E  S  R  M  E  V                              815
2641  GGATGACTATAGTCAGTATGAGGAAGAAGTACAGATGATTCCTCCTCCTTCTGAGGGCGA                                   2700
816        D  D  Y  S  Q  Y  E  E  E  S  T  D  D  S  S  S  E  G  D                                  835
2701  TGAAGAGGAGGATGACTATGATGATGAGTTTGAAGACGATTTATTCCTCCTTCCTCCAGC                                   2760
836        E  E  D  D  Y  D  D  D  F  E  D  D  F  I  P  L  P  P  A                                  855
2761  TAAGCGCTTGAGGTTAATAGTTGGAAAAAGACTCTATAGATATTGACATTTCTTCAAGGAG                                   2820
856        K  R  L  R  L  I  V  G  K  D  S  I  D  I  D  I  S  R  R                                  875
2821  AAGAGAAGATCAGTCTTTAAGGCTTAATGCCTAAGCTCTTGGTCTTAACTTGACCTGGGA                                    2880
876        R  E  D  Q  S  L  R  L  N  A  *                                                         886
2881  TAACTACTTTAAAGAGAAATAAAAAAATTCCAGTCAATTATTCCTCAACTGAAAGTTTAGTGG                                2940
2941  CAGCACTTCTATTGTCCCTTCACTTATCGACATATTGTAGAAAGTACAGCATACT                                        3000
3001  GACTCAATTCTTAAGTCTGATTGTGCAAATTTGTCTACTTTTTAAATCGTACAGCCTTCTT                                  3060
3061  ACGTGCAATTCTGAGTAGAGCAACTTTCCACACAGCTGGCTCTTTAATAAAGGCTCAAGCAAAATTG                            3120
3121  TACAGTGATAGAGCACATCAGCTGTAAACAGGAGACGTTGAATATATGCTACACAGTTTT                                   3180
3181  TTTAACTGTAAGAGCAGCATAAGGGTTTCTAGAGTTCCCCCTTGTTAATAATCACCAGCAATGATCTTTG                         3240
3241  ATCATAGTAGCTTTATATTGCTAGATGTTTGTGGCCTTGTAAAAAAACGACATACGTTCAGTTTCACACTGTTT                      3300
3301  GCTTTTGATTTTCTTTAAAAAAAACCTTGTACTGTTTGTGGCCCAGGTGTAAAAACCATTGGTTGGGAGTC                         3360
3361  GCTGGCCCAGGTGTTCTTTAAAAAAAACGACATACGTGACAGCTCACTTTTCAGTT                                       3420
3421  AGATTGGTTTCTTTAAAAAAAACGACATACGTGACAGCTCACTTTTCAGTT                                            3480
3481  CATGATATGTGAGGGTAGCAGTGTGGGATGAGGTTCGATACAGCGTATTTATTGCT                                        3540
3541  TGTCATGTAAATTAAAAAACCTTGTCTATTGTAATTAACTCTTTTTAGATAAAAATTGTT                                    3600
3601  CTTTGCAAGCAACATTTATCTAATGAATTGTGCTTATTTCAAAATTGCTGTGAACAACGTGATGACA                            3660
3661  ACAAGCAACATTTATCTAATGAACTACAGCTATTGAACTATTAAAAATCTATTCACTTTTAACTTATAATAG                        3720
3721  TGCACTTGTAAATAAAACACTACAAGGAATATTAAAAAATCTATTCACTTTAACTTATAATAG                                 3780
3781  TTTATGAAATAAAAACATGAGTCACAGCTTTTGTTCTGTGGTAACCTATAAAAAAAGTTT                                    3840
3841  GTCTTTGAGATTCAATGTAAAGAACTGAAAACAATGTATATGTTGTAAATATTGTGTGT                                     3900
```

FIG. 18D

```
3901  TGTGAGAAATTTTGTCATAAGAAATTAAAAGAACTTACCAGGAAGGTTTTAAGTTTAG  3960
3961  AAATATTCATGCCAATAAAATAGGAAATTATAAATATATAGTTTTAAGCACTGCATCAGT  4020
4021  GGGAGTTCTTGGCTTATCAGTTAGTTTATGTTAGTTTATTATGAAAACATCAAAGATTTTT  4080
4081  TGACTATATTATCAGTTAAACAAAAGGAGTCAGATTTAATTGTTTTTGAAGCACTTT  4140
4141  GAGAAATTAATTTTAATTAACTTAATGAGCAAATTTTATTACTTTATGTTCAATAC  4200
4201  CAGGTTCTTTTCATTCTCTGGATTATTTGCAAATCATTGGACAGAGAATTTGGAATA  4260
4261  TAAATCTGTAACAGGTGTTTGACACCAGTAGGTCTCTTTATTTCTGGGAAATGTGTACCT  4320
4321  GTACTTTCTGATATACAGTGTTCCTAAGTAAAAATCAATTCAGGGATTTGTATAGTGTC  4380
4381  TATAGGAAAGTAGCCCATGTCTCTTGAAATATGAAAAGGAATCTGAAGGTCATGAAAAGTCC  4440
4441  AGTGGAGAAAATCTCAATGCTTACTGTTACTACTAATTGATTCCTACTAGTTTCCAGTT  4500
4501  TGGGGGATATTGTTTCAATGACGCTCCTTAAGACTGTTGATTGCCCATAGTTTCCAAAT  4560
4561  AGAAATTAAGACTCATGAACATTTTTAGAAAGTAGATTGTTTTCTCCTGGTTCTCTAAGG  4620
4621  AACTACTTCTGCAGTTCTTACATAGTCTCATCCTTGTTTGTTGTGCAGTCAGTCGAACTCCT  4680
4681  CAGGCGTTTGGAAAGCATGTGGTAGAACATGAAGTAGGCAGCACGTCCAGCCCCCGTTCACT  4740
4741  GCGTCTGGAGGTCTTCAACAGTGAAGTGAAGATGAAGTAGGCAGCACGTCCAGCCCCCGTTCACT  4800
4801  TCCGAGGCACCCCGCCACCTCTTGTATTCCAACCTTAGTTTGGGGTGTGTTTTGAAGAGGTTCAGAG  4860
4861  AATGTGAACCGGGTCACCTCTTGTATTCCAACCTTAGTTTGGGGTGTGTTTTGAAGAGGTTCAGAG  4920
4921  GGCAGCGGGTCACCTCTTGTATTCCAACCTTAGTTTGGGGTGTGTTTTGAAGAGGTTCAGAG  4980
4981  ACTAAATCTTAAACCTTATTTCAGCTGAATTTTAGTAACTTATTTT  5040
5041  AAAGTGACAAAACACATTTTATCATGCCCTTCCTTTGGAGGCCAACTTCCCATGGGTCTCAAAG  5100
5101  GATGTTTTAATTTTATCATGCCCTCCTCCTTGCCCTCTCAGGAGTCGGTAGCACTCAGCA  5160
5161  CAGTGACATTTGGTAGTAAATCACTGGTAAATCCAGGAGTCGGTAGCACTCAGCA  5220
5221  GCCACTGTTGATGCCTTCTGCTAGGAGAACTTCACCGTGTGGAATGTGACAGCCACACCGTTG  5280
5281  ACTGTTCCGGATCTGCTAGGAGAACTTCACCGTGTGGAATGTGACAGCCACACCGTTG  5340
5341  ACCAGTTAGAGAGGTTGCATTGTAAGAATTAGGAGATGATCATAGAAATATGTCAATGATTGG  5400
5401  TTAAGATTTGCATTGTAAGAATTAGGAGATGATCATAGAAATATGTAAAGTATTCA  5460
5461  ATTTTCAATCATTTTCAAATTACTGTTATAAATTGTTTTTGCTGAGTTGTAATACTTTTG  5520
```

FIG. 18E

```
5521  AGATACAATGTATTCCTTGTACTGAAAGAATGAAAAAGGACTTTTTCAGCATTGAGGTA
5581  AGTTCTTTAACGTTTCATTAAAAACATTTTTACAAATATTTTGTACATGCACTTGCAGT
5641  ATTGAGGTTAATCATTTTAATAAATTCGGAAATTAAACAATTAAACAATTTGGCCGGTGTTCACTGT
5701  ATCT  5704
```

FIG. 18F

```
Zmax20
    1      CTAATACGACTCACTATAGGGCTCGAGCGGCCGCCCGGGCAGGTGTGGTAACAACGCGGA      60
   61      GTACGCGGCGGGGAAGATGGCGGCGGCCATGGCAGCATCTTCCCTGACGGTCACCTTAGGG     120
    1                  M   A   A   A   M   A   A   A   S   L   T   V   T   L   G       15
  121      CGGCTGGCGTCCGCGTGCAGCACAGCCACAGCATCCTGAGACCTTCGGGGCCCGGAGCAGCCTCC     180
   16       R   L   A   S   A   C   S   H   S   I   L   R   P   S   G   P   G   A   A   S     35
  181      CTTTGGTCTGCTTCTCGAAGGTTCAATTCACAGAGCACTTCATATCTACCAGGATATGTT     240
   36       L   W   S   A   S   R   R   F   N   S   Q   S   T   S   Y   L   P   G   Y   V     55
  241      CCTAAAACATCCCTGAGTTCACCACCTTGGCCAGAAGTTGTTCTGCCAGACCCAGTTGAG     300
   56       P   K   T   S   L   S   S   P   P   W   P   E   V   V   L   P   D   P   V   E     75
  301      GAGACCAGACACCATGCAGAGGTCGTGAAGAAGGTGAATGAGATGATCGTCACGGGGCAG     360
   76       E   T   R   H   H   A   E   V   V   K   K   V   N   E   M   I   V   T   G   Q     95
  361      TATGGCAGGCTCTTTGCCGTGGTGCACTTTGCCAGCCAGTGGAAGGTGACCTCTGAA     420
   96       Y   G   R   L   F   A   V   V   H   F   A   S   R   Q   W   K   V   T   S   E    115
  421      GACCTGATCTTAATTGGAAATGAACTAGACCTTGCTTGTGTGGAGAGAATTCGACTGGAG     480
  116       D   L   I   L   I   G   N   E   L   D   L   A   C   G   E   R   I   R   L   E    135
  481      AAGGTCCTGCTGGTTGGGGCAGAAGACAACTTCACGCTGCTTGGCAAGCCACTCCTCGGAAAG     540
  136       K   V   L   L   V   G   A   D   N   F   T   L   L   G   K   P   L   L   G   K    155
  541      GATCTTGTTCGAGTAGAAGCAACAGTTGAAGAAGACAGAATCATGGCCAAGAATCATT     600
  156       D   L   V   R   V   E   A   T   V   I   E   K   T   E   W   P   R   I   I    175
  601      ATGAGATTCAGGAGAAGAAAAGGAAAAACTTCAAGAAGAAAGAATCGTCACGACCCGCAGACT     660
  176       M   R   F   R   K   R   K   N   F   K   K   K   R   I   V   T   T   P   Q   T    195
  661      GTCCTCCGGATAAACAGCATTGAGATTGCTCCGTGTTTGTTGATTACCGAGTTAATAC     720
  196       V   L   R   I   N   S   I   E   I   A   P   C   L   L                            209
  721      TTACAAAAGGATAAAAATAAACTCCCTGCTTCCCAAGGAAAAAAAAAAAAAAAAAAA     777
```

FIG. 19

```
Zmax61A    1    TGCGCAGTGAAGCTGGGCGCCTTCGGGCGCCTTCTGAGCTTCTGAGGGTCGGGTCCAGCGCGTG         60
           61   GGCTGCTGGATGGCGGAACCCCAGGCGGAGTCGGAGCCCCTGCTGGGTCGGGGGCCCGGGC        120
            1                M  A  E  P  Q  A  E  S  E  P  L  L  G  G  A  R  G          17
          121   GGTGGCGGCGACTGGCCGGGGCCAGGTGGGACCCTCTGCATTCAGGCATCCAAGTCGGCCCTGGT        180
           18   G  G  G  D  W  P  A  G  L  T  T  Y  R  S  I  Q  V  G  P  G          37
          181   GCCGCGGCCAGGTGGGACCCTCTGCATTGATCAGGCTGTGGTCTTCATCGAAGATGCTATT        240
           38   A  A  A  R  W  D  L  C  I  D  Q  A  V  V  F  I  E  D  A  I          57
          241   CAGTACCGCTCCATCAACCACCGGGTGGATGCCAGTCGATGTGGCTTTACGACGGTAT        300
           58   Q  Y  R  S  I  N  H  R  V  D  A  S  M  W  L  Y  R  Y            77
          301   TACTCGAACGTATGCCAAGGACTTTGAGCTTCACCATCTTCTTGATCCTGTTTTTGGCT        360
           78   Y  S  N  V  C  Q  R  T  L  S  F  T  I  F  L  I  L  F  L  A          97
          361   TTTATCGAGACCCCATCCCTCGCGGACGTGTCGAGGTGCTCTGCCTGGTCTTTGCG           420
           98   F  I  E  T  P  S  L  T  S  T  A  D  V  R  Y  R  A  A  P         117
          421   TGGGAGCCGCCCTGTGGCCTGACCGAGAGTGTTCGGGTGGCCCATTTCCAGAAAAACCTTTGG        480
          118   W  E  P  P  C  G  L  T  E  S  V  L  F  G  W  A  H  F  Q  K  N  L  W     137
          481   GCCGACTTCTGTGAAGGGTTACCTGCTGGTGTCTCTGGTGTTCTTCTGGTGGACTGGACCGTGTCCCTGAGT        540
          138   A  D  L  S  V  K  G  Y  L  F  G  V  V  S  L  V  D  W  T  V  S  L  S      157
          541   CTCGTGTGTCATGAGCCCCTGCGGATCCGCCGGCTTCTCCGTCCTTCTTCCTGCTGCAG        600
          158   L  L  G  Y  L  V  V  L  V  V  S  L  V  V  S  L  R  P  F  F  L  L  Q      177
          601   CTCGTGTGTCATGAGCCCCTGCGGATCCGCCGGCTTCTCCGTCCTTCTTCCTGCTGCAG            660
          178   L  V  C  H  E  P  L  R  I  R  R  L  L  R  P  F  F  L  L  Q         197
          661   AACTCCTCTATGATGAAGAAGACCTTGAAATGCATCCGCTGGTCGCTGCCGGAAATGGCC        720
          198   N  S  S  M  M  K  K  T  L  K  C  I  R  W  S  L  P  E  M  A         217
          721   AGCGGTCGGGCTGCTGCTCTGCCCATCCACCTGTGCCTCTTCACCATGTTCGGAATGCTGCTG        780
          218   S  V  G  L  L  A  I  H  L  C  L  F  T  M  F  G  M  L  L          237
          781   TTCGCTGGTGGGAAGCAGGATGATGGCCAGGACAGGGAGAGGCTGACTTACTTCCAGAAC        840
          238   F  A  G  K  Q  D  D  G  Q  D  R  E  R  L  T  Y  F  Q  N          257
```

FIG. 20A

| | | |
|---|---|---|
| 841 | CTGCCTGAGTCTCTCTGACTTCCCTCCTGGTGCTGCTGACCACGGCCAACAACCCCGATGTG | 900 |
| 258 | L P E S L T S L L V L L T T A N N P D V | 277 |
| 901 | ATGATTCCTGCGTATTCCAAGAACCGGGCCTATGCCATTCTTCATAGTCTTCACTGTG | 960 |
| 278 | M I P A Y S K N R A Y A I F F I V F T V | 297 |
| 961 | ATAGGAAGCCTGTTTCTGATGAACCTGCTGACAGCCATCATCTACAGTCAGTTCCGGGGC | 1020 |
| 298 | I G S L F L M N L L T A I I Y S Q F R G | 317 |
| 1021 | TACCTGATGAAATCTCTCCAGACCTCGTTTCGGAGGCGGCTGGGAACCGGGCTGCC | 1080 |
| 318 | Y L M K S L Q T S F R R R L G T R A A | 337 |
| 1081 | TTTGAAGTCCTATCCTCCATGGTGCAGGTGCTTCAGGTGCTTCAGGCAGTTGGGGTG | 1140 |
| 338 | F E V L S S M V Q V L Q K V Q A V G V | 357 |
| 1141 | AAGCCCCAGAACTTGCAGGTGCTTCCTATGGCCGTTCCTATGGCTGTCTGCAGCTGAGGAGTTTCAG | 1200 |
| 358 | K P Q N L Q V L Q K V L D S H R Q | 377 |
| 1201 | GCCATGATGGAGAAGGTGCGTTCCTATGGCCGTTCTGCTCTCAGCTGAGGAGTTTCAG | 1260 |
| 378 | A M M E K V R S Y G S V L S A E F Q | 397 |
| 1261 | AAGCTCTTCAACGAGCTTGACAGAAGTGTGGTTAAAGAGCACCCGCCGAGGCCGAGTAC | 1320 |
| 398 | K L F N E L D R S V V K E H P P R P E Y | 417 |
| 1321 | CAGTCTCCGTTTCTGCAGAGCGCCCAGTTCCTCTTCGGCCATTACTACTTTGACTACCTG | 1380 |
| 418 | Q S P F L Q S A Q F L F G H Y Y F D Y L | 437 |
| 1381 | GGGAACCTCATCGCTGCCAAACCTGGTGTCTTCCTTGTGTTCCTTGGTGCTGGATGCA | 1440 |
| 438 | G N L I A A N L V S I C V F L V L D A | 457 |
| 1441 | GATGTGCTGCCTGCTGAGCGTGATGACTTCATCCTGGGAATTCTCAACTGCGTCTTCATT | 1500 |
| 458 | D V L P A E R D D F I L G I L N C V F I | 477 |
| 1501 | GTGTACTACCTGTTGGAGATGCTGCTCAAGGTCTTTGCCCTGGCCTTGTCCGAGGGTACCTG | 1560 |
| 478 | V Y Y L L E M L L K V F A L G L R G Y L | 497 |
| 1561 | TCCTACCCCAGCAACGTGTTTGACGGGCTCCTCACCGTTGTCCTGGCTGGAGGCCGGAGA | 1620 |
| 498 | S Y P S N V F D G L L T V V L A G G R R | 517 |
| 1621 | TGGTGGGCCTGCTGCCGCTGTCGCTGTGGGACATGACCCGCGGCACTGAACATGCTCATCGTGTTCC | 1680 |
| 518 | W W A C C R C R C G T * | 527 |

FIG. 20B

```
1681  GCTTCCTGCGTATCATCCCCAGCCATGAAGCCGATGGCCCGTGGTGGTGCCAGTACCGTCCTGG  1740
1741  GCCTGGTGCAGAACATGCGTGCCGTTGTTTAGAGGCGGATCCTGGTGGTCTACTACGTATTTG  1800
1801  CCATCATTGGGATCAACTTGTTCGGCGCCCCCTGTGGCGTCTTCCTGGAAACAGCAGCC      1860
1861  TGGCCCCTGCCAATGGCTCGGCGCTGCCCTGTGGGAGCTTCGAGCAGCAGCTGGAGTACTGGGCCA 1920
1921  ACAACTTCGATGACTGTTTCTGGCTGGCATATGCGGCTACTCGTGTGACTTGATGGTGTGAACA 1980
1981  ACTGGCAGGTGTTTCTGGCTGGTGTCGTCGTGCCTACTCAGGGCGTGGTCCAAGATCTATT   2040
2041  TTGTATTGTGTGGCTGCCACAAGTGGGACCCCCGCAGCAGCCCCTGCTGCAGCCCCCTTGATTC 2100
2101  TGGAGAACTTCCTTCACACAAGTGGGACTGACTGTGAGCTCCCTGTTCAGGGATATTCTGGAGACCCC 2160
2161  CAGAGGCCACCTACCAGATGACTGTGAGCTGCTGAGCTGCTGTTCAGGGACACCCGCACCACGCGCACCCGCACCACGCG 2220
2221  GGGAGGAGGATGAGCTCACAGAGGCAGGGGCGGCCAGGTCCAGCCAGGAAGAGAGCCCAGGGCAG 2280
2281  GTCCGGGCTGCCGTCTGTGGCCATGCTGTGGCCCAGGAAGAGCCAGGAAGAGACCTTTCCTGACG 2340
2341  ATCATGGAAGAGGCGGCCAAGTCTGGGACACAGGAACCAAGTCCTTTGCCGTGTGGCCCAACAACCATCTACAG 2400
2401  GACCACTAAGCTGTGTCAGGGAGGCGCACAGGGGACCTCCAGAGGACCTTTCTTTATAGCTGCTTCA 2460
2461  AACAGTGCTGTCCCTCGTGCTTCAGGGAGGCGCACAGGACCCGGACTCCACAGGGACCTTTCAGACAAAAATGCAAGAAGCAGCGG 2520
2521  GTGAGAATTCCCTCGTCGAGCTGAGCTCCACAGGAGACTTCTGCCGGCAGCATTCCGGCAGCCCTTTCCTTGCTGGACTTCAGAGCGG 2580
2581  CCTCCCCTGCTGTCCCTGTACCAGGGCCTGACAGAGGACTTCTGCCGGCAGCCCTGCAGCCCTTTCCTTGCTGGGACCAC 2640
2641  AGGCCTGACCAGGGCCTGACATGGAGAGGAACCTTGACTGTGTTTATTTATTTTCAGGCATTCAGGGATGGGAT 2700
2701  GCTGGTGGTTTGACATGGAGAGGAACCTTGACTGTGTTTCTGATTGCCAGTGTTCCAGTGTTCTCATGGCTTGTATGA 2760
2761  GTGTGACTGGTGGTTTGACATGGAGAGGAACCTTGACTGTGTTTCTGATTGCCAGTTTCATTCATCAGTAAGTCTT 2820
2821  GCAAAGAATGGGATTGTCATTCTTCACTTCAGCACACAGTTCTTCACTTCAGCCTTTCTCTGAGT 2880
2881  AGGGTTGTTGAGTAAGGTTGCTTGGGTTGTGCATTGCACAAGGCACATGGCTGTGAGGT       2940
2941  GTATCCTGCGGGGGGAACCAATGGGGTGACCTTATTTCGTGTGTCTTCAGGGCCTTGCAAAG     3000
3001  GCATGTATAAGCCAGGGTCGACCAAATGGTTTTCTCAGGCGATGTGGTTGTGTGTCAGGGGCC  3060
3061  TGGGGTGGGGAGGTCCATCTAGTGGGATGGGATTGGTTGACTCCCGGGACACCACGCGCACCACGCG 3120
3121  CGCCAGGTCCAGATTGACCAACTCCCAGAAACAACTCCCCATCACACTCCAC          3180
3181  TGCTGAGGTTTGGGTGCCATCTAGTGGGATGGGATTGGTTGACTCCCGGGACACCACGCGCACCACGCG 3240
3241  AGGTGGACCCAGCAACTCCCAGAAACAACTCCCCATCACACTCCAC              3300
3301  ACCGAGCCTGGTGCCCGGTCTGTGCCCGAGCTCAGCGGGACCAGGAAGGATGGCCCTG        3360
```

FIG. 20C

| | | |
|---|---|---|
| 3361 | CCAGGGTTGCCCCTGCACTGTGCATTCTCGCCTGGGAGGCACAAGTTCTTTCATCTGCTT | 3420 |
| 3421 | TTCCTTCAGAGGTGCTGAGCCCCTGTGGGATGGTGGGGAGGGGCGA | 3480 |
| 3481 | CCCGAACAACAGTGCAGTCGGTATCGAGATTGGGAGAGGAGCGAGTCCAAGGAGAAAGT | 3540 |
| 3541 | CATGAGTTCTTTTACTCGTGTTGAATAATAACAATAACAATAACAATATGGA | 3600 |
| 3601 | AACCACCGCAAACTTGGAGAAAAGTTGTAAGCACACAGTAAAGAAGCTTCCTTCTGAGTC | 3660 |
| 3661 | AGTTGAGTGGTTGCCGTTCTGGCCTGTCTGTCTTTGGCACCCTCTGTCTTTGGACGGCGTCCAACCCG | 3720 |
| 3721 | CATTCATGTCAGGAGTGAGTGAGTCGCACGTGGCTTGACGACTTAATCCGCCTGG | 3780 |
| 3781 | ACGTGGCTCCGTTCCCTGGGCTTGTCATGTAGACGTTCCTTGTGTGGTCACTTCTGGAGATAAGCCATGG | 3840 |
| 3841 | CTCCCAGGTTGTGTTCATGTGTTGCTGGAGCAGGTTTCTGGGTAGGTTCTGGGTTCTGCGTTTGTCT | 3900 |
| 3901 | AGGAGTGTCACAGGATGGACACTGGCCTCCCCTGGGCTTAGACGAGTTGGTTCTGCCCAATGCAGTTAGCCCTCC | 3960 |
| 3961 | TGCTGGTGTTCTCTCTTTGCTTGTTGGTGAAGGTGGCCCCTGGTCAGTTCTCCACTGCCCA | 4020 |
| 4021 | GTGAACGACCCCTTTGTAATGAATGAGTGGGAGGTAGTGTGAAGCGATGCCAATATCCC | 4080 |
| 4081 | ATCCCTGTCAAACTGCCTTTACTTTTTCCTCCACCTGTGGATCCT | 4140 |
| 4141 | GGTCCCTTCTTGTATTCAGGGCTGTGGTCTGTGTCTTTATGACATTTACTCTCAGGCTCAGGTCC | 4200 |
| 4201 | TGCTTGTTTGGCCCGTGGAGCCCCTTTACTTTCTGCCTTTTGTGTTTTTTGTTATGTACC | 4260 |
| 4261 | TACAGTTCTTTAGCTGTGTTTCTTTCTTTCATTTACTTTCTGGTGCAAAAAGATGTCAAGCTCTAAGCCTTATTTA | 4320 |
| 4321 | TACTTGCCCTGCCCCTTTTCATTTATTGGAGTGAGCTGCAGCTCTAAGAAGACCTG | 4380 |
| 4381 | TTCTTTTGAATGGAGAGTAGCATCAGGAACCAGGAGCTCTTAGTGACAGAGCTAGAGGATATGTGCACGT | 4440 |
| 4441 | TGTTGCAGATTGCTGCACCCGGAGCTTCATCTATTCACAGCTGGAATGATACTAATACTTCCGA | 4500 |
| 4501 | ACTTCCATCTCTCTCTGTCTCATCCAGTTCTTTCTCTTTCCATAGCTGTAAGGCC | 4560 |
| 4561 | TTTTAGCCCAGCACCAGGGTTCTCATTCTCCTTAATCTATTATTGGGTCAGTTTTCCTGCATGTC | 4620 |
| 4621 | CTTTCTGGGAATGGTTCTCATTCTCCTTAATCTATTATTGGGTCAGTTTTCCTGCATGTC | 4680 |
| 4681 | CCCAGCCTCCCCATCACTGCCACCACTCCCCACACTCCCTGCTCATCCGACTGGGG | 4740 |
| 4741 | CTTTGACTCCCACACTGTGTACCCCTCTGTGTGGACGCCCCTGCTGCCAAAACCTTCAGC | 4800 |
| 4801 | AAACAGTTTCCAAATGAAGTTGTCACTGTCAGGGCCTTTACAATCAGCAACAGCAAAA | 4860 |
| 4861 | TCTACATGCTGCTGAGGGTCCCTGCCTCATTAAGATGCAATAAATATGTAAGTACATAAAA | 4920 |

FIG. 20D

```
4921  ACAGCAATATAGAAGAAACGTAATGCTTTTTCTCAAATATGATGTCTACATAGAAAAGCCA  4980
4981  AAATTATTAAGAATAGTAAGAATTCACCCAGCACTTTGGGAGGCCGAGGCGGGTGGATCA  5040
5041  TGAGGTCAGGAGAGATCGAGACCATCCTGGCTAACAAGGTGAAACCCCGTCTCTACTAAAAA  5100
5101  TACAAAAAATTAGCCGGGCGTGGTGGCGCCTGTAGTCCCAGCTACTGGGAGGCTG  5160
5161  AGGCAGGAGAATGGCGTGAACCCGGGAAGCGGAGCTTGCAGTGAGCCGAGATTGCGCCAC  5220
5221  TGCAGTCCGCAGTCCCAGCCCTGGGGACAGAGCGAGACTCCGTCTCAAAAAAA  5273
```

FIG. 20E

```
Zmax61B    1  TGCGCAGTGAAGCTGGGCGCGCCCTTCGGGCGCCTTCGAGCTTCTGAGGGTCTCGGGTCCAGCGCGCGTG    60
          61  GGCTGCTGGATGGCGGAACCCCAGGCGGAGTCGGAGCCCCTGCTGGGCGGGGCCCCGCGGC          120
           1                 M  A  E  P  Q  A  E  S  E  P  L  L  G  G  A  R  G         17
         121  GGTGGCGGCGGCGACTGGCCCGGCGGGTGGGACCTCTGCATTGACCACTTACCGGTCGATCCAAGTTGGT  180
          18  G  G  G  D  W  P  A  G  L  T  T  Y  R  S  I  Q  V  G  P  G          37
         181  GCCGCGGGCCAGGTGGACCTCTGTGAAGGTGTCTTGGTCTTGTGGTCTTCATCGAAGATGCTATT      240
          38  A  A  A  R  W  D  L  C  I  D  Q  A  V  F  I  E  D  A  I            57
         241  CAGTACCGCTCCATCAACCACCGGGTGGATGCCAGCTCGATGTGGCTTTACCGACGGTAT          300
          58  Q  Y  R  S  I  N  H  R  V  D  A  S  S  M  W  L  Y  R  R  Y         77
         301  TACTCGAACGTATGCCAAGACTTTGAGCTTCACCATCTTCTTTGATCCTGTTTTTGGCT           360
          78  Y  S  N  V  C  Q  R  T  L  S  F  T  I  F  L  I  L  F  L  A         97
         361  TTTATCGAGACCCCATCCTCACTCCAGACGGACGTGCGCTACCGCGCTGCCCCC               420
          98  F  I  E  T  P  S  S  L  T  S  T  A  D  V  R  Y  R  A  A  P        117
         421  TGGGAGCCGCCCTGCGGCCTGACCGAGAGTGTCGAGGTGCTCTGCCTGGTCTTTGCG            480
         118  W  E  P  P  C  G  L  T  E  S  V  E  V  L  C  L  V  F  A          137
         481  GCCGACCTCTCTGTGAAGGGTTACCTGTTCGGGTGGGCCCATTTCCAGAAAAACCTTTGG         540
         138  A  D  L  S  V  K  G  Y  L  F  G  W  A  H  F  Q  K  N  L  W        157
         541  CTGCTGGGCTACCTGTGGTCGTGGTCTCTGGTGGTGTCGCTGGTGGACTGGACCGTGTCCCTGAGT   600
         158  L  L  G  Y  L  V  V  V  S  L  V  D  W  T  V  S  L  S             177
         601  CTCGTGTGTCATGAGCCCCTGCGGATCCGCCGCCTTCTCCGTCCCTTCTTCCTGCTGCAG         660
         178  L  V  C  H  E  P  L  R  I  R  R  L  L  R  P  F  F  L  L  Q        197
         661  AACTCCTCTATGATGAAGAAGACCTTGAAATGCATCCGCTGGTCGCTGCCGGAAATGGCC        720
         198  N  S  S  M  M  K  K  T  L  K  C  I  R  W  S  L  P  E  M  A        217
         721  AGCGGTCGGGCTGCTGCTGGCCATGCCTCTTCACCTGTGCCCTCTGTTCGGAATGCTGCTG        780

FIG. 21A
```

```
218  S   V   G   L   L   L   A   I   H   L   C   L   F   T   M   F   G   M   L   L    237
781  TTCGCTGTGGGAAGCAGGAGGATGATGGGCTGCAGGAGAGGCTGACCTACTTCCAGAAC                       840
238  F   A   G   G   K   Q   D   D   G   Q   D   R   E   R   L   T   Y   F   Q   N    257
841  CTGCCTGAGTCTCTGACTTCCCTCCTGGTCCTGCTGACCGGCCAACGGCCAACCCCGATGTG                   900
258  L   P   E   S   L   T   S   L   L   V   L   L   T   A   N   P   D   V            277
901  ATGATTCCTGCGTATTCCAAGAACCGGGCCTATGCCATTCTTCTTCATAGTCTTCACTGTG                   960
278  M   I   P   A   Y   S   K   N   R   A   Y   A   I   F   F   I   V   F   T   V    297
961  ATAGGAAGCCTGTTTCTGATGAACCTGACAGCTATCATCTACAGTCAGTTCCGGGGC                       1020
298  I   G   S   L   F   L   M   N   L   T   A   I   I   Y   S   Q   F   R   G        317
1021 TACCTGATGAAATCTCTCCAGACCTCGCTGTTTCGGAGGCGGCTGGGAACCCGGGCTGCC                    1080
318  Y   L   M   K   S   L   Q   T   S   L   F   R   R   R   L   G   T   R   A   A    337
1081 TTTGAAGTCCTATCCTCCATGGTGGGGGAGGGAGCCTTCCCTCAGGCAGTTGGGGTG                       1140
338  F   E   V   L   S   S   M   V   G   E   G   G   A   F   P   Q   A   V   G   V    357
1141 AAGCCCCAGAACTTGCAGGTTGCTTCAGAAGGTCCAGCTGGACTGGACAGCTCCCACAGACAG                 1200
358  K   P   Q   N   L   Q   V   L   Q   K   V   Q   L   D   S   S   H   R   Q        377
1201 GCCATGATGGAGAAGGTGCGTTCCTATGGCAGTGTCTTGCTCTCAGCTGAGGAGTTTCAG                    1260
378  A   M   M   E   K   V   R   S   Y   G   S   V   L   L   S   A   E   E   F   Q    397
1261 AAGCTCTTCAACGAGCTTGACAGAAGTGTGGTTAAAGAGCACCCGCCGAGGCCGGAGTAC                    1320
398  K   L   F   N   E   L   D   R   S   V   V   K   E   H   P   P   R   P   E   Y    417
1321 CAGTCCCCGTTTCTGCAGAGCGCCCAGTTCCTGGTTCTTGGTGTTCCCATTTGCTGTTCCTGGATGCA            1380
418  Q   S   P   F   L   Q   S   A   Q   F   L   V   F   G   H   Y   F   D   Y   L    437
1381 GGGAACCTCATCGCCCTGGCAAACCTGGTGATGACTTCATCCTGGGATTCTCAACTGCTTCATT                1440
438  G   N   L   I   A   L   A   N   L   V   S   I   C   V   F   L   V   L   D   A    457
1441 GATGTGCCTGCTGAGCGTGATGATTTCATCCTGGGAATTCTCAACTGCGTCTTCATT                       1500
458  D   V   L   P   A   E   R   D   D   F   I   L   G   I   L   N   C   V   F   I    477
1501 GTGTACTACCTGTTGGAGATGCTGCTCAAGGTCTTTGCCCTGGGCGAGGGTACCTG                        1560
```

```
  738  L   T   E   R   L   S   Q   H   P   H   L   W   L   C   R   *                                                  753
 2341  CGTCCCAGCAGGGCGGCAGCCAGGAGAGAGGCTGGCCTACACAGGTGCCCATCATGAAGA  2400
 2401  GGCGGCCATGCTGTGGCCAGCCAGGCAGGAAGAGACCTTTCCTGACGGACCACTAAGC   2460
 2461  TGGGACAGGAACCAAGTCCTTGCGTGTGGCCCTGCCCAACAACCATCTACAGAACAGCTGCTG  2520
 2521  GTGCTTCAGGGAGGCGCCGTGCCCGTTCTTTATAGCTGCTTCAGTGAGAATTCCC       2580
 2581  TCGTCGACTCCACAGGAGACCTTTCAGACAAAAATGCAAGAAGCAGCGGCCTCCCCGTCC  2640
 2641  CCTGCAGCTTCCGTGGTCTTCCGTGCCGCAGCCCTTGGGACCACAGGCCTGACCAG      2700
 2701  GGCCTGCACAGGTTAACCGTGACTTGTTTTATTATTTCATGGCTTCAGTGTGGTTTG     2760
 2761  ACATGGAGAGAACCTTGACTTGTGTTTATTTCATCAGTAAGTCTTGCAAAGAATGGG     2820
 2821  GTGTTTCTTTAGGGTTCTCACTTCAGCACAGTTCTAGTCCTGCTTCTCTGAGTAGGTTGTTGAG  2880
 2881  ATTGTCATTCTTGGGTTGTGCATTGCACAAGGCACATGGCTGTGAGGTGTATCCTGGCGG  2940
 2941  TAAGGTTGCTGTCTACCTGCAGTGAGGGCACCTTTTCTGTTTTGCTCAAAGGCATGTATAAGC  3000
 3001  GGGGCTGTCTGACCTTATTCCTGTGTCTTCAGGTGTGGCAGGCCTGGGGTGGGGAG      3060
 3061  CAATGGGTGACCTTATTCCTGTGTCTTCAGGTGTGGCAGGCCTGGGGTGGGGAG        3120
 3121  GTGGGGCCGAGCGAGCAGTGTGTGAAAGCCTTGTTGTCACCTCAGGCACGCCAGTCCAG   3180
 3181  ATTGACCAATGTGTTTCTCACTTCAGGGATGGAACATTAAGGTAAGGTGACCCAG       3240
 3241  GGTGCCATCTAGTGGTGGGATGGAACTCCGGGACTTGGTTGACTACATTAAGGTGACCCAG  3300
 3301  CAACTCCCAGAAACAACTCGCCCGAGCTCAGCGGGACACCACTCCACACTCCACACCGAGCCTGGT  3360
 3361  GCCCGGTCTGTGCCATTCGCGCCTGGCTCAGCGGGACCAGGAAGGCCCTGCCAGGGTTGCCC  3420
 3421  CTGCACTGTGGCCCGCTTCGCCATTCTCTGGGAGGCACACAAGTTCTTCTGCTTTCCTTCAGAGG  3480
 3481  TGCTGAGCCCACGCTATCGAGATTGGGATGGTGGAGGCGAGTCCAAGGAGGAGAAAGTCAGTTTCTT  3540
 3541  TGCAGTCGGTATCGAGATTGGAATAATAACAGTACACAATAACAATATGGAAACCACCGCAAA  3600
 3601  TTTACTCGTGTTGAATAACAATAACAGTACACAATAACAATATGGAAACCACCGCAAA    3660
 3661  CTTGGAGAAAGTTGTAAGCACACTAAAGAGAAGCTTCCTTCTGAGTCAGTTGAGTGGTT   3720
 3721  GCCGTTCTGGCCGTGGCCCCTGCACCCCTTCTGTGCTTTTGGACGCGTCCAACCCGACTTGAGTCAG  3780
 3781  GAGTGAGTCGCACGTGGCTTTGTGGTCATGGCGGACTTAATCCGCCTGACGGTGGCTCCG  3840
```

FIG. 21D

```
3841  TCTCCCTGGGCTTAGACGACCTTGGCACTTCTGGAGATAAGCCCATGGCTCCCAGGTTGT  3900
3901  GTTCATGTGACGTTTCCTTGTGGTAGTTCTGGGTTCTGCGTTTGTCCTAGGAGTGTCACA  3960
3961  GGATGGACACTGCCTCCTGCAGGGGCTGCCCAATGCAGTTAGCCTCTCCACTGCTGGTTCT  4020
4021  CTCTTGTTGCTTGGTGAAGGTGGCCCTGGTCAGTTCTCCAGTGCCCAGTGAACGACCCC  4080
4081  TTTGTAATGAATGAGTGGGGAGGTAGTGTGAAGCGATGCCAATATCCCATCCCTGTCAAA  4140
4141  CTGCCCTTTACTTTTTCCTTCCTGTTATGACATTTACTTCTCAGGCTGTGTGGATCCTGTTG  4200
4201  TATTCAGGGCTGTGGTCTGTGTCTCTTTATGACATTTACTTCTCAGGCTGTCCTTGTTTGGC  4260
4261  CCGTGGGAGCCCCTTACTTTCTGGTGCAAAAAGATGTTCAAGCCTTATTTTATACTTGCC  4320
4321  GCTGTTTCTTCTTTACTTTCATTTATTGGAGTGAGCTGCAGCTCTAAGAAGACCTGTTCTTTTGAATG  4380
4381  CCTTTCTCTTCTTCATTTATTGGAGTGAGCTGCAGCTGTGGTGCGCTCCTGGCTGTGTTGCAGATTG  4440
4441  GAGAGTAGCATCAGGAACCAGGATCTCTTAGTGGACAGAGCTAGAATGATACTAATACCTCCGATTTTAGCCCAGC  4500
4501  CTGCACCCGGTCTCATCTATTCACAGCTGGGAATGATACTAATACCTCCGATTTTAGCCCAGC  4560
4561  CTCTCTGTCTCATCTATTCACAGCTGGGAATGATACTAATACCTCCGATTTTAGCCCAGC  4620
4621  ACCACAGGGTACGTTCTCCAGTTTTCTCTTCCATAGTCTGTAAGGCCCCTTTCTGGAAT  4680
4681  GGTTCTCATTCTCCTTAATCTATTGGGTCAGTTTTCCTGCATGTCCCCAGCCCTCCCA  4740
4741  TCACTGCCACCCACTCCCCACAGAGATGCCCCGCCTGCTCCGACTGGGGCTTTGACTCCCA  4800
4801  CACTGTGTACCCCCTTGTGTGTGGACGCGCCTTTACAATCAGCAACAGCAAAATCTACATGCTGC  4860
4861  AAATGGAAGTTGTCACTGTGCCTCAGGCCCTTTACAATCAGCAACAGCAAAATCTACATGCTGC  4920
4921  TGAGGGTCCTGCCTCATTAAGATGCAATAAGTCAATAAGTAAACAGCAATAGAA  4980
4981  GAAACGTAAGAATGCTTTTTCTCAAATGCACTTTGGGAGGCCGAAAAAGCCAAAATTATTAAGA  5040
5041  ATAGTAAGAATTCACCCAGCTCTGGCTAACAAGGTGAAACCCCGTGGATCATGAGGTCAGGAG  5100
5101  ATCGAGACCATCCTGGCTAACAAGGTGAAACCCCGTCTACTAAAAATACAAAAATTA  5160
5161  GCCGGGCGCGGTGGCGGGCGCCTGTAGTCCCAGCTACTGGGAGGCTGAGGCAGGAGAAT  5220
5221  GGCGTGAACCCGGGAGGCGGAGCTTGCAGTGAGCCGAGATTGCGCCACTGCAGTCCGCAG  5280
5281  TCCAGCCCTGGGCGACAGAGCGAGACTCCGTCTCAAAAAAAA  5321
```

FIG. 21E

```
Zmax113    1  GCCCGGAGCTGCCTGGGTTGCGCTGCCGCGGCCACGTCCCCGCGGCCTCAGGCTCCTT     60
          61  CCTACTGTCCGAGGGCCACCAGCCGCGGGCCTGCTGCGCCCGGATGCTGTCTGTTAC    120
         121  TAGAGTGGAGAGTCTACCTTCGTCTCACATGTGCCCAAAGGATGGCCCGGGAGT       180
         181  GCCCCACCACGTGGCTTTCACCCCTGCAAAGACTTCGCCCCAGCGACACAGTGTCA    240
         241  AGCCCACAGCTCTCCAAGGAGGAAGATGGTCCAGGCTGGGAGCATCCCCTTAGCAGC    300
         301  CTCTGATCCCTTGGCCAAGCAGGAGGGAACCATTAGCAGCCTGAGGAGCTGGCTGG    360
         361  GAGCCTCGGGGACCGCCCCAGCCTTGCTCCCCAGCTCACCCACAAGATGTGGACAGCTCTTG  420
                                                            M   W   T   A   L   V      6
         421  TGCTCATTTGGATTTTCTCCCTTGTCCCTTATCTGAAAGCCATGCGGCATCCAACGATCCAC  480
              L   I   W   I   F   S   L   S   L   S   E   S   H   A   A   S   N   D   P   R   26
         481  GCAACTTTGTCCCTAACAAAATGTGGAAGGATTAGTCAAGAGGAATGCATCTGTGAAA   540
              N   F   V   P   N   K   M   W   K   G   L   V   K   R   N   A   S   V   E   T   46
         541  CAGTTGATAATAAAACGTCTGAGGATGTAACCATGGCAGCAGCTTCTCCTGTCACATTGA   600
              V   D   N   K   T   S   E   D   V   T   M   A   A   A   S   P   V   T   L   T   66
         601  CCAAAGGGACTTCGGCAGCCACCTCAACTCTATGGAAGTCACAACAGAGGACACAAGCA   660
              K   G   T   S   A   A   H   L   N   S   M   E   V   T   T   E   D   T   S   R   86
         661  GGACAGATGTGAGTGAACCAGCAACTTCAGGAGTTGCAGCTGATGGTGTGACCTTCCATTG   720
              T   D   V   S   E   P   A   T   S   G   V   A   A   D   G   V   T   S   I   A   106
         721  CTCCCACGGCTGTGGCCCTCCAGTACGACTGCCATTACGACTGCGGGCCTCCAGTA       780
```

FIG. 22A

```
 107    P    T    A    V    A    S    S    T    T    A    A    S    I    T    T    A    A    S    S    M     126
 781  TGACTGTGGCCTCCAGTGCTCCACGACTGCAGCCTCCAGTACAACTGTGGCCTCCATTG                                              840
 127    T    V    A    S    S    A    P    T    T    A    A    S    T    T    V    A    S    I    A          146
 841  CTCCCACGACTGCAGCCTCCAGTATGACTGCCACTCCAGCACTGCCATGACACTTGCAC                                              900
 147    P    T    T    A    A    S    M    T    A    A    S    T    P    M    T    L    A    L              166
 901  TCCCCGCGCCACGTCCACTTCCACAGGGCGGACCCCGTCCACTACCGCCACTGGCATC                                               960
 167    P    A    P    T    S    T    G    R    T    P    S    T    F    A    T    G    H    P              186
 961  CATCTCTCAGCACAGCCCTCGCACAAGTGCCAAAGAGCAGCGCGTTGCCAAGAACAGCAA                                            1020
 187    S    L    S    T    A    L    A    Q    V    P    K    S    S    A    L    P    R    T    A    T    206
1021  CCCTGGCCACATTGGCCACGTGCTCAAGACTGTAGCGACCACAGCAAACACAAGCAGCC                                            1080
 207    L    A    T    L    R    A    Q    T    V    A    T    T    A    N    T    S    S    P              226
1081  CCATGAGCACTCGTCGTTCCAAGTCCTTCCAAGCACATGCCAGTGACACCGCGGCAAGCCCTG                                        1140
 227    M    S    T    R    P    S    P    S    K    H    M    P    S    D    T    A    A    S    P    V    246
1141  TACCCCCTATGCGTCCCCAAGCACAAGGTCCCATTAGCCAGGTGTCAGTGACCAGCCTG                                            1200
 247    P    P    M    R    P    Q    A    Q    G    P    I    S    Q    V    S    V    D    Q    P    V    266
1201  TGGTTAACACAACAAATAAATCCACACCCATGCCCTCAAACACAACCCCAGAGCCCGCCC                                           1260
 267    V    N    T    T    N    K    S    T    P    M    P    S    N    T    T    P    E    P    A    P    286
1261  CCACCCCCACAGTGGTGACCACCACCAAGGCACAAGGGAGCCAACTGCCAGCCCAG                                                1320
 287    T    P    T    V    V    T    T    T    K    A    Q    A    R    E    P    T    A    S    P    V    306
1321  TGCCAGTACCTCACACCCCCAATCCCTGAGATGGAGGCCATGTCCCCCACGACACAGC                                             1380
```

FIG. 22B

```
307        P    V    P    H    T    S    P    I    P    E    M    E    A    M    S    P    T    T    Q    P       326
1381   CAAGCCCCATGCCATATACCCAGAGGGCCGCTGGGCCAGGCACATCCCAGGCACCGGAGC                                                1440
327        S    P    M    P    Y    T    Q    R    A    A    G    P    G    T    S    Q    A    P    E    Q       346
1441   AGGTAGAGACTGAAGCCACCAGGTACTGATTCCACTGGGCCAACACCCAGGAGCTCAG                                                   1500
347        V    E    T    E    A    T    P    G    T    D    S    T    G    P    P    P    R    S    S    G       366
1501   GGGGCACTAAGATGCCAGCCACGGACTCGTGCCAGCACCCAAGGCCAGTACATGG                                                     1560
367        G    T    K    M    P    A    T    D    S    C    Q    P    S    T    Q    G    Q    Y    M    V       386
1561   TGGTCACCACTGAGCCCCTCACCCAGGCCGTGTAGACAAAACTCTCCTTCTGGTGC                                                    1620
387        V    T    T    E    P    L    T    Q    A    V    V    D    K    T    L    L    V    V    L            406
1621   TGTTACTCGGGTGACCCTTTTCATCACAGTCTTGGTTTTGTTTGCCCTGCAGGCCTATG                                                 1680
407        L    L    G    V    T    L    F    I    T    V    L    F    A    L    Q    A    Y    E                 426
1681   AGAGCTACAAGAAGGACTACACCCAGGTGGACTACTTAATCAACGGGATGTATGCGG                                                   1740
427        S    Y    K    K    D    Y    T    Q    V    D    Y    L    I    N    G    M    Y    A    D            446
1741   ACTCAGAGAAATGTGAGGGGCCTGGCGGGAGGCCTGGCCCCTTCCTCGTCCTTT                                                      1800
447        S    E    M    *                                                                                         450
1801   CCTTTTGCCTTTGAGACCAAACCAAGTGCTTCCAAATTCTTTTGGTGCAATTGAGGAGAT                                                1860
1861   ATGCCAGATGCTTAAACACATTAATTGCTGTCAGATTAATTCCATGATCACTAAAGAGT                                                 1920
1921   TGCTGCTTTTTTTTTAAAAAACAAAAAATAAAAAAAAAAAAAGGAAAAAAAAAAAA                                                    1980
1981   TAAAAAAAAAAAAAAAAAAAAAAAAAAAAAAAA    2014
```

FIG. 22C

HUMAN GENES OF CHROMOSOME 11Q13.3

RELATED APPLICATIONS

This application is a Divisional of U.S. application Ser. No. 09/358,001 filed Jul. 21, 1999 now abandoned, which claims the benefit of U.S. Provisional Application No. 60/134,103, filed May 14, 1999, and claims the benefit of U.S. Provisional Application No. 60/105,511, filed Oct. 23, 1998, and is also a Continuation-in-Part which claims priority to U.S. application Ser. No. 09/229,319, filed Jan. 13, 1999 now abandoned, which claims the benefit of U.S. Provisional Application No. 60/071,449, filed Jan. 13, 1998, the contents of all of which are incorporated in their entirety.

BACKGROUND

Chromosomal region 11q13 has been identified as an area of the human genome that has been genetical linked to a variety of diseases including osteopetrosis (Heaney et al., Hum. Mol. Genet. 7(9) 1407–10 (1998), osteoarthritis (Chapman et al., Am. J. Genet 65:000—000, 1999), asthma (Laing et al., J. Med. Genet. 35(6) 463–7 (1998)), multiple myeloma (Fonseca et al., Br. J. Haematol. 101(2) 296–301 (1998)), plasma cell leukemia, (PCL) (Shimazaki et al., Int. J. Hematol. 66(1):111–5 (1997), breast cancer (Hui et al., Oncogene 15(13):1617–23 (1997)), head and neck squamous cell carcinoma (Wang et al., Anticancer Res. (2A): 925–31 (1999)), and atopic dermatitis (Folster-Holst et al., Hum. Genet. 102(2):236–9 (1998)). In addition, this region has been linked to high bone mass (Johnson et al., Am. J. Hum. Genet. 60:1326–1332(1997)).

Despite the localization of many human diseases to region 11q13, the majority of genes responsible for these disorders have not yet been identified or characterized. There have been some indications of function for the 11q13 genes which have been identified. For example, it has been suggested that LRP5 is somehow linked to insulin dependent diabetes mellitus 4, (Nakagawa et al., Am. J. Hum. Genet. 63:547–556 (1998)). Further, MKS2 is involved in Meckel Syndrome (Roume et al., Am. J. Genet 63:1095–1101, (1998)); VMD2 gene is involved in Best's vitelliform macular dystrophy (Cooper et al., Genomics, 49(3):419–29 (1998); cyclin D1 gene is implicated in mantle cell lymphoma (Pott et al., Leukemia 12(10):1630–7 (1998)), and MENINI gene is involved in multiple endocrine neoplasia type 1 (Wang et al., Cancer Res., 58(19):4417–20(1998)). Thus, there is a great need for identification and characterization of other genes of the 11q13 region and their encoded proteins.

SUMMARY OF THE INVENTION

This invention relates to genes, Zmax7A, Zmax7B, Zmax8A, Zmax8B, Zmax20, Zmax61A, Zmax61B, and Zmax113 located on chromosome 11q13.3. Nucleic acids comprising all or a part of, or complementary fragments of Zmax7A, Zmax7B, Zmax8A, Zmax8B, Zmax20, Zmax61A, Zmax61B, and Zmax113 genes and cDNA are described in various embodiments. Vectors and host cells containing the nucleic acids herein described are also included in this invention. These nucleic acids can be used in therapeutic applications for a multitude of diseases either through the overexpression of a recombinant nucleic acid comprising all or a portion of a Zmax7A, Zmax7B, Zmax8A, Zmax8B, Zmax20, Zmax61A, Zmax61B, and Zmax113 gene, or by the use of these oligonucleotides and genes to modulate the expression of an endogenous gene or the activity of an endogenous gene product. Examples of therapeutic approaches include anti-sense inhibition of gene expression, gene therapy, monoclonal antibodies, that specifically bind to the gene products, and the like. Recombinant expression of the gene products in vitro can also be obtained.

Diagnostic methods are also described which utilize all or part of the nucleic acids of this invention. Such nucleic acids can be used, for example, as part of diagnostic methods to identify Zmax7A, Zmax7B, Zmax8A, Zmax8B, Zmax20, Zmax61A, Zmax61B, and Zmax113 nucleic acids for a predisposition to various genetic diseases. In addition, nucleic acids described herein can be used to identify chromosomal abnormalities within the 11q13 region.

Further, this invention identifies various single nucleotide polymorphic sites (SNP's) within several of the nucleic acids described herein. The SNPs, together with the wildtype alleles can be used to prepare specific probes for detection of various disease states in an individual. Thus, in one embodiment, this invention provides a method of detecting chromosome abnormalities on chromosome 11q13.3.

Proteins, polypeptides, and peptides encoded by all or a part of the nucleic acids comprising Zmax7A, Zmax7B, Zmax8A, Zmax8B, Zmax20, Zmax61A, Zmax61B, and Zmax113 are included in this invention. Such amino acid sequences are useful for diagnostic and therapeutic purposes. Further, antibodies can be raised against all or a part of these amino acid sequences for specific diagnostic and therapeutic methods requiring such antibodies. These antibodies can be polyclonal, monoclonal, or antibody fragments.

In a further embodiment, vectors and host cells containing vectors which comprise all or a portion of the nucleic acid sequences of this invention can be constructed for nucleic acid preparations, including anti-sense, and/or for expression of encoded proteins and polypeptides. Such host cells can be prokaryotic or eukaryotic cells.

This invention also includes nonhuman transgenic animals containing one or more of the nucleic acids of this invention for screening and other purposes. Further, knockout nonhuman transgenic animals can be produced wherein one or more endogenous genes or portions of such genes corresponding to the nucleic acids of this invention are replaced by marker genes or are deleted.

BRIEF DESCRIPTION OF THE FIGURES

FIGS. 3A–3E depict the genomic structure of Zmax7A (SEQ ID NO:28) with the flanking intron sequence. Translation is initiated by the underlined, bolded "ATG" and the 3' UTR is underlined.

FIGS. 4A–4E depict the genomic structure of Zmax7B (SEQ ID NO:29) with the flanking intron sequence. Translation is initiated by the underlined, bolded "ATG" and the 3' UTR is underlined.

FIGS. 5A–5C depict the genomic structure of Zmax8A (SEQ ID NO:30) with the flanking intron sequence. Translation is initiated by the underlined, bolded "ATG" and the 3' UTR is underlined.

FIGS. 6A–6E depict the genomic structure of Zmax8B (SEQ ID NO:31) with the flanking intron sequence. Translation is initiated by the underlined, bolded "ATG" and the 3' UTR is underlined.

FIG. 7 depicts the genomic structure of Zmax20 (SEQ ID NO:32) with the flanking intron sequence. Translation is initiated by the underlined, bolded "ATG" and the 3' UTR is underlined.

FIGS. 8A–8E depict the genomic structure of Zmax61A (SEQ ID NO:33) with the flanking intron sequence. Translation is initiated by the underlined, bolded "ATG" and the 3' UTR is underlined.

FIGS. 9A–9E depict the genomic structure of Zmax61B (SEQ ID NO:34) with the flanking intron sequence. Translation is initiated by the underlined, bolded "ATG" and the 3' UTR is underlined.

FIGS. 15A–15H depict the nucleotide (SEQ ID NO:1) and amino acid sequence of Zmax7A (SEQ ID NO:9). The boundaries for the 5' UTR is from bases 1–321, and the 3' UTR boundaries is from bases 2844–5316.

FIGS. 16A–16I depict the nucleotide (SEQ ID NO:2) and amino acid sequence of Zmax7B (SEQ ID NO:10). The boundaries for the 5' UTR is from bases 1–405, and the 3' UTR boundaries is from bases 2755–4992.

FIGS. 17A–17D depict the nucleotide (SEQ ID NO:3) and amino acid sequence of Zmax8A (SEQ ID NO:11). The boundaries for the 5' UTR is from bases 1–196, and the 3' UTR boundaries is from bases 2854–3433.

FIGS. 18A–18F depict the nucleotide (SEQ ID NO:4) and amino acid sequence (SEQ ID NO:12) of Zmax8B. The boundaries for the 5' UTR is from bases 1–196, and the 3' UTR boundaries is from bases 2854–5704.

FIG. 19 depicts the nucleotide (SEQ ID NO:5) and amino acid sequence (SEQ ID NO:13) of Zmax20. The boundaries for the 5' UTR is from bases 1–75, and the 3' UTR boundaries is from bases 703–777.

FIGS. 20A–20E depict the nucleotide (SEQ ID NO:6) and amino acid (SEQ ID NO:14) sequence of Zmax61A. The boundaries for the 5' UTR is from 1–69, and the 3' UTR boundaries is from bases 1650–5273.

Figure 21C:
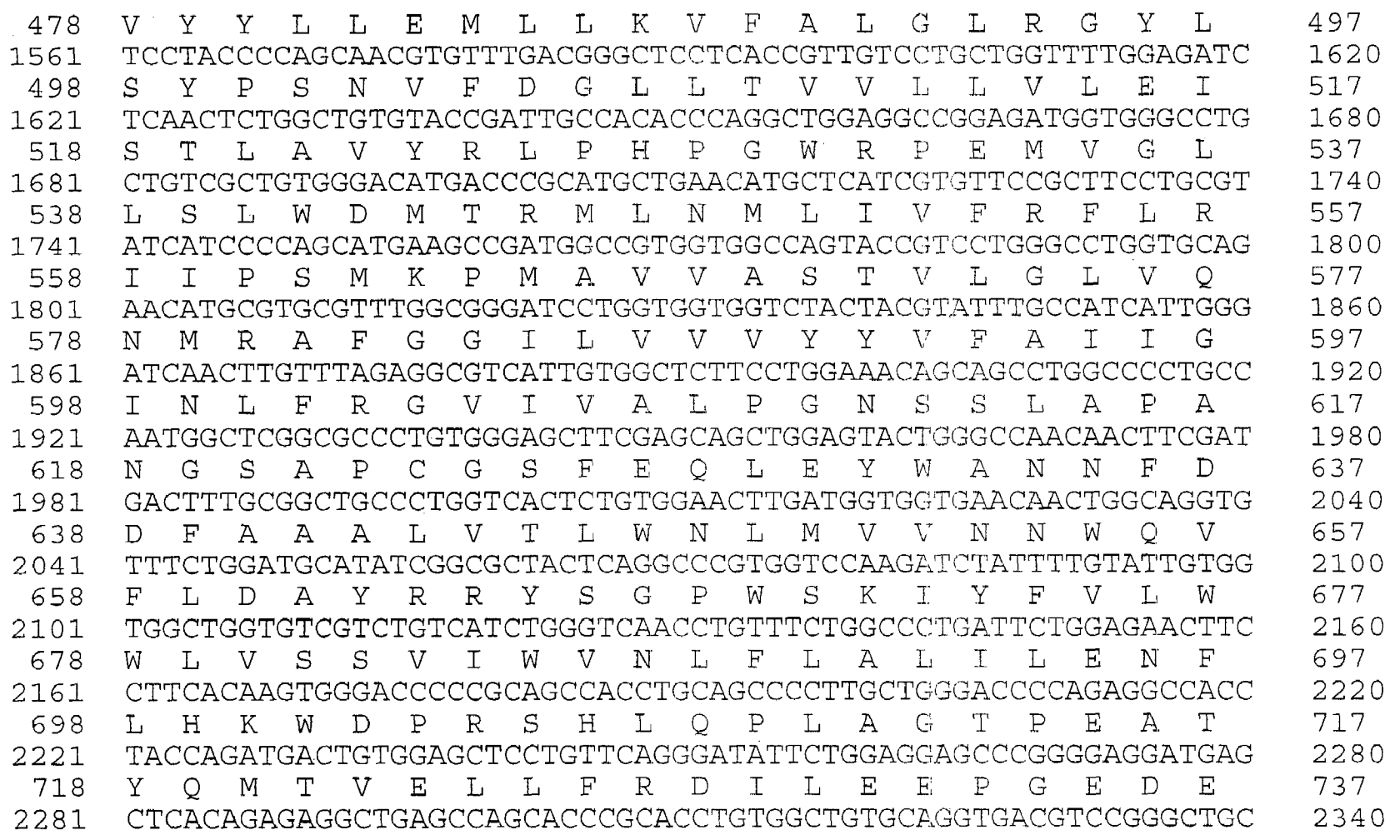

FIGS. 21A–21E depict the nucleotide (SEQ ID NO:7) and amino acid sequence (SEQ ID NO:15) of Zmax61B. The boundaries for the 5' UTR is from 1–69, and the 3' UTR boundaries is from bases 2329–5321.

FIGS. 22A–22C depict the nucleotide sequence (SEQ ID NO:8) and the putative amino acid sequence of Zmax113 (SEQ ID NO:16).

DETAILED DESCRIPTION OF THE INVENTION

Figure 1A:
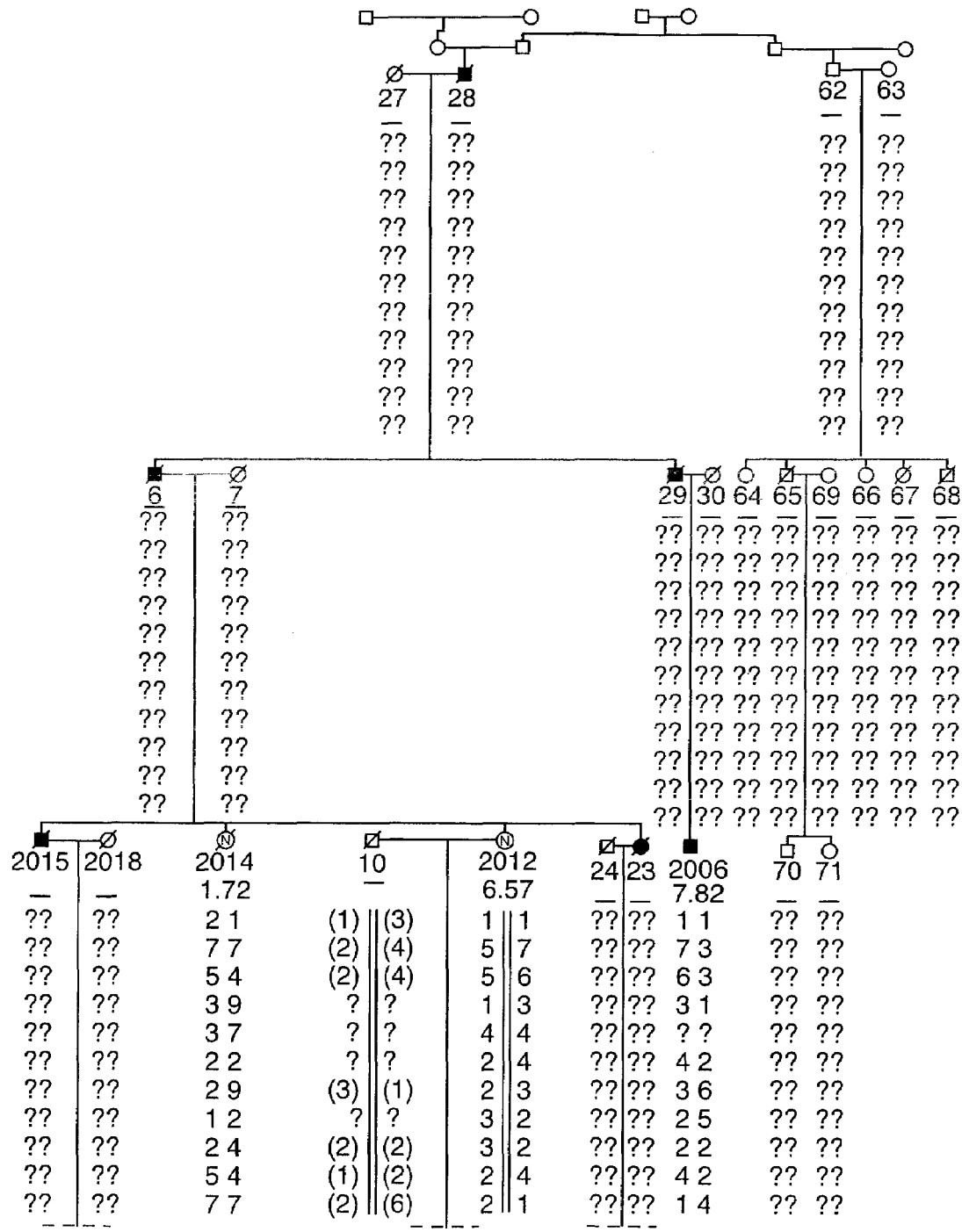
FIGS. 1A–1B show the pedigree of the individuals used in genetic linkage studies. Under each individual is an ID number, the z-score for spinal BMD, and the allele calls for the critical markers on chromosome 11. Solid symbols represent "affected" individuals. Symbols containing "N" are "unaffected" individuals. DNA from 37 individuals was genotyped. Question marks denote unknown genotypes or individuals who were not genotyped.

The present invention relates to Zmax7A, Zmax7B, Zmax8A, Zmax8B, Zmax20, Zmax 61A, Zmax61B, and Zmax113 nucleic acids comprising genomic DNA (FIGS. 3A–3E, 4A–4E, 5, 6A–6E, 7, 8A–8E, and 9A–9E), the corresponding cDNA sequences (FIGS. 15A–15H, 16A-16I, 17A–17D, 18A–18F, 19, 20A–20E, 21A–21E, and 22A–22C), RNA, fragments of the genomic, cDNA, or RNA nucleic acids comprising 20, 40, 60, 100, 200, 500 or more contiguous nucleotides, and the complements thereof. Closely related variants are also included as part of this invention, as well as recombinant nucleic acids comprising at least 50, 60, 70, 80, or 90% of the nucleic acids described above which would be identical to a Zmax7A, Zmax7B, Zmax8, Zmax20, Zmax 61, and Zmax113 nucleic acids except for one or a few substitutions, deletions, or additions.

Zmax7A and Zmax7B are isoforms which were processed from a single transcription event. Similarly, Zmax8A and Zmax8B are isoforms, as are Zmax61A and Zmax61B.

Further, the nucleic acids of this invention include the adjacent chromosomal regions of Zmax7A, Zmax7B, Zmax8, Zmax20, Zmax 61, and Zmax113 required for accurate expression of the respective gene. In a preferred embodiment, the present invention is directed to at least 15 contiguous nucleotides of the nucleic acid sequence of any of FIGS. 3A–3E, 4A–4E, 5, 6A–6E, 7, 8A–8E, 9A–9E, and 22A–22B. More particularly, embodiments of this invention include the BAC clones containing segments of Zmax7A, Zmax7B, Zmax 8, Zmax 20, Zmax 61 and Zmax 113 gene region B200E21-H and B527D12-H. A preferred embodiment is the nucleotide sequence of the BAC clones consisting of SEQ ID NOs:17–27 and those listed in Table 3.

This invention further relates to methods using isolated and/or recombinant nucleic acids (DNA or RNA) that are characterized by their ability to hybridize to (a) a nucleic acid encoding a protein or polypeptide, such as a nucleic acid having any of the sequences of SEQ ID NO:1, SEQ ID NO:2, SEQ ID NO:3, SEQ ID NO:4, SEQ ID NO:5, SEQ ID NO:6, SEQ ID NO:7, or SEQ ID NO:8 or (b) a portion of the foregoing (e.g., a portion comprising the minimum nucleotides Zmax7A, Zmax7B, Zmax8A, Zmax8B, Zmax20, Zmax61A, Zmax61B and Zmax113 protein required to encode a functional Zmax7A, Zmax7B, Zmax8A, Zmax8B, Zmax20, Zmax61A, Zmax61B, and Zmax113 protein; or by their ability to encode a polypeptide having the amino acid sequence of SEQ ID NO:9, SEQ ID NO:10, SEQ ID NO:11, SEQ ID NO:12, SEQ ID NO:13, SEQ ID NO:14, SEQ ID NO:15, or SEQ ID NO:16, or to encode functional equivalents thereof; e.g. a polypeptide which when incorporated into a cell, has all or part of the activity of a Zmax7A, Zmax7B, Zmax8A, Zmax8B, Zmax20, Zmax61A, Zmax61B and Zmax113 protein, or by both characteristics. A functional equivalent of a Zmax7A, Zmax7B, Zmax8A, Zmax8B, Zmax20, Zmax61A, Zmax61B, and Zmax113 protein, therefore, would have a similar amino acid sequence (at least 65% sequence identity) and similar characteristics to, or perform in substantially the same way as Zmax7A, Zmax7B, Zmax8A, Zmax8B, Zmax20, Zmax61A, Zmax61B, and Zmax113 protein. A nucleic acid which hybridizes to a nucleic acid encoding a Zmax7A, Zmax7B, Zmax8A, Zmax8B, Zmax20, Zmax61A, Zmax61B, and Zmax113 protein or polypeptide, such as SEQ ID NO:1, SEQ ID NO:2, SEQ ID NO:3, SEQ ID NO:4, SEQ ID NO:5, SEQ ID NO:6, SEQ ID NO:7, or SEQ ID NO:8 can be double- or single-stranded. Hybridization to DNA such as DNA having the sequence SEQ ID NO:1, SEQ ID NO:2, SEQ ID NO:3, SEQ ID NO:4, SEQ ID NO:5, SEQ ID NO:6, SEQ ID NO:7, or SEQ ID NO:8 includes hybridization to the strand shown or its complementary strand.

In one embodiment, the percent amino acid sequence similarity between a Zmax7A, Zmax7B, Zmax8A, Zmax8B, Zmax20, Zmax61A, Zmax61B, and Zmax113 polypeptide such as SEQ ID NO:9, SEQ ID NO:10, SEQ ID NO:11, SEQ ID NO:12, SEQ ID NO:13, SEQ ID NO:14, SEQ ID NO:15, SEQ ID NO:16, respectively, and functional equivalents thereof is at least about 50%. In a preferred embodiment, the percent amino acid sequence similarity between such a Zmax7A, Zmax7B, Zmax8A, Zmax8B, Zmax20, Zmax61A, Zmax61B, and Zmax113 polypeptide and its functional equivalents is at least about 65%. More preferably, the percent amino acid sequence similarity between a Zmax7A, Zmax7B, Zmax8A, Zmax8B, Zmax20, Zmax61A, Zmax61B, and Zmax113 polypeptide and its functional equivalents is at least about 75%, and still more preferably, at least about 80%.

To determine percent nucleotide or amino acid sequence similarity, sequences can be compared to the publicly available unigene database (National Center for Biotechnology Information, National Library of Medicine, 38A, 8N905, 8600 Rockville Pike, Bethesda, Md. 20894; www.ncbi.nlm-.nih.gov) using the blastn2 algorithm (Altschul, *Nucl. Acids Res.*, 25:3389–3402 (1997)). The parameters for a typical search are: E=0.05, v-50, B=50 (where E is the expected probability score cutoff, V is the number of database entries returned in the reporting of the results, and B is the number of sequence alignments returned in the reporting of the results (Altschul et al, *J. Mol. Biol.*, 215:403–410 (1990)).

Isolated and/or recombinant nucleic acids meeting these criteria comprise nucleic acids having sequences identical to sequences of naturally occurring Zmax7A, Zmax7B, Zmax8A, Zmax8B, Zmax20, Zmax61A, Zmax61B, and Zmax113 genes and portions thereof, or variants of the naturally occurring genes. Such variants include mutants differing by the addition, deletion or substitution of one or more nucleotides, modified nucleic acids in which one or more nucleotides are modified (e.g., DNA or RNA analogs), and mutants comprising one or more modified nucleotides.

Such nucleic acids, including DNA or RNA, can be detected and isolated by hybridization under high stringency conditions or moderate stringency conditions, for example, which are chosen so as to not permit the hybridization of nucleic acids having non-complementary sequences. "Stringency conditions" for hybridizations is a term of art which refers to the conditions of temperature and buffer concentration which permit hybridization of a particular nucleic acid to another nucleic acid in which the first nucleic acid may be perfectly complementary to the second, or the first and second may share some degree of complementarity which is less than perfect. For example, certain high stringency conditions can be used which distinguish perfectly complementary nucleic acids from those of less complementarity. "High stringency conditions" and "moderate stringency conditions" for nucleic acid hybridizations are explained on pages 2.10.1–2.10.16 (see particularly 2.10.8–11) and pages 6.3.1–6 in *Current Protocols in Molecular Biology* (Ausubel, F. M. et al., eds., Vol. 1, containing supplements up through Supplement 29, 1995), the teachings of which are hereby incorporated by reference. The exact conditions which determine the stringency of hybridization depend not only on ionic strength, temperature and the concentration of destabilizing agents such as formamide, but also on factors such as the length of the nucleic acid sequence, base composition, percent mismatch between hybridizing sequences and the frequency of occurrence of subsets of that sequence within other non-identical sequences. Thus, high or moderate stringency conditions can be determined empirically.

High stringency hybridization procedures (1) employ low ionic strength and high temperature for washing, such as 0.015 M NaCl/0.0015 M sodium citrate, pH 7.0 (0.1×SSC) with 0.1% sodium dodecyl sulfate (SDS) at 50° C.; (2) employ during hybridization 50% (vol/vol) formamide with 5× Denhardt's solution (0.1% weight/volume highly purified bovine serum albumin/0.1% wt/vol Ficoll/0.1% wt/vol polyvinylpyrrolidone), 50 mM sodium phosphate buffer at pH 6.5 and 5×SSC at 42° C.; or (3) employ hybridization with 50% formamide, 5×SSC, 50 mM sodium phosphate (pH 6.8), 0.1% sodium pyrophosphate, 5× Denhardt's solution, sonicated salmon sperm DNA (50 g/ml), 0.1% SDS, and 10% dextran sulfate at 42° C., with washes at 42° C. in 0.2×SSC and 0.1% SDS.

By varying hybridization conditions from a level of stringency at which no hybridization occurs to a level at which hybridization is first observed, conditions which will allow a given sequence to hybridize with the most similar sequences in the sample can be determined.

Exemplary conditions are described in Krause, M. H. and S. A. Aaronson (1991) *Methods in Enzymology*, 200:546–556. Also, see especially page 2.10.11 in *Current Protocols in Molecular Biology* (supra), which describes how to determine washing conditions for moderate or low stringency conditions. Washing is the step in which conditions are usually set so as to determine a minimum level of complementarity of the hybrids. Generally, from the lowest temperature at which only homologous hybridization occurs, a 1% mismatch between hybridizing nucleic acids results in a 1° C. decrease in the melting temperature $T_m$, for any chosen SSC concentration. Generally, doubling the concentration of SSC results in an increase in $T_m$ of ~17° C.

Using these guidelines, the washing temperature can be determined empirically for moderate or low stringency, depending on the level of mismatch sought.

Isolated and/or recombinant nucleic acids that are characterized by their ability to hybridize to (a) a nucleic acid encoding a Zmax7A, Zmax7B, Zmax8A, Zmax8B, Zmax20, Zmax61A, Zmax61B, or Zmax113 polypeptide, such as the nucleic acids depicted as SEQ ID NO:1, SEQ ID NO:2, SEQ ID NO:3, SEQ ID NO:4, SEQ ID NO:5, SEQ ID NO:6, SEQ ID NO:7, or SEQ ID NO:8, (b) the complement of SEQ ID NO:1, SEQ ID NO:2, SEQ ID NO:3, SEQ ID NO:4, SEQ ID NO:5, SEQ ID NO:6, SEQ ID NO:7, or SEQ ID NO:8, (c) or a portion of (a) or (b) (e.g. under high or moderate stringency conditions), may further encode a protein or polypeptide having at least one function characteristic of a Zmax7A, Zmax7B, Zmax8A, Zmax8B, Zmax20, Zmax61A, Zmax61B, or Zmax113 polypeptide, such as translocation activity (e.g., transport of -lactamase across a bacterial cell membrane), or binding of antibodies that also bind to non-recombinant Zmax7A, Zmax7B, Zmax8A, Zmax8B, Zmax20, Zmax61A, Zmax61B, or Zmax113 protein or polypeptide. The catalytic or binding function of a protein or polypeptide encoded by the hybridizing nucleic acid may be detected by standard enzymatic assays for activity or binding (e.g., assays which measure the binding of a transit peptide or a precursor, or other components of the translocation machinery). Enzymatic assays, complementation tests, or other suitable methods can also be used in procedures for the identification and/or isolation of nucleic acids which encode a polypeptide such as a polypeptide of the amino acid sequence SEQ ID NO:9, SEQ ID NO:10, SEQ ID NO:11, SEQ ID NO:12, SEQ ID NO:13, SEQ ID NO:14, SEQ ID NO:15, or SEQ ID NO:16, or a functional equivalent of this polypeptide. The antigenic properties of proteins or polypeptides encoded by hybridizing nucleic acids can be determined by immunological methods employing antibodies that bind to a Zmax7A, Zmax7B, Zmax8A, Zmax8B, Zmax20, Zmax61A, Zmax61 B, or Zmax113 polypeptide such as immunoblot, immunoprecipitation and radioimmunoassay. PCR methodology, including RAGE (Rapid Amplification of Genomic DNA Ends), can also be used to screen for and detect the presence of nucleic acids which encode Zmax7A, Zmax7B, Zmax8A, Zmax8B, Zmax20, Zmax61A, Zmax61B, or Zmax113-like proteins and polypeptides, and to assist in cloning such nucleic acids from genomic DNA. PCR methods for these purposes can be found in Innis, M. A., et al. (1990) *PCR Protocols: A Guide to Methods and Applications*, Academic Press, Inc., San Diego, Calif., incorporated herein by reference.

It is understood that, as a result of the degeneracy of the genetic code, many nucleic acid sequences are possible which encode a encode Zmax7A, Zmax7B, Zmax8A, Zmax8B, Zmax20, Zmax61A, Zmax61B, or Zmax113-like protein or polypeptide. Some of these will have little homology to the nucleotide sequences of any known or naturally-occurring Zmax7A, Zmax7B, Zmax8A, Zmax8B, Zmax20, Zmax61A, Zmax61B, or Zmax113-like gene but can be used to produce the proteins and polypeptides of this invention by selection of combinations of nucleotide triplets based on codon choices. Such variants, while not hybridizable to a naturally-occurring Zmax7A, Zmax7B, Zmax8A, Zmax8B, Zmax20, Zmax61A, Zmax61B, or Zmax113 gene, are contemplated within this invention.

The nucleic acids described herein are used in the methods of the present invention for production of proteins or polypeptides, through incorporation into cells, tissues, or organisms. In one embodiment, DNA containing all or part of the coding sequence for a Zmax7A, Zmax7B, Zmax8A, Zmax8B, Zmax20, Zmax61A, Zmax61B, or Zmax113 polypeptide, or DNA which hybridizes to DNA having the sequence SEQ ID NO:1, SEQ ID NO:2, SEQ ID NO:3, SEQ ID NO:4, SEQ ID NO:5, SEQ ID NO:6, SEQ ID NO:7, or SEQ ID NO:8, is incorporated into a vector for expression of the encoded polypeptide in suitable host cells. The encoded polypeptide consisting of Zmax7A, Zmax7B, Zmax8A, Zmax8B, Zmax20, Zmax61A, Zmax61B, or Zmax113, or its functional equivalent is capable of normal activity, such as bone modulation, cellular proliferation, and/or inflammation. The term "vector" as used herein refers to a nucleic acid molecule capable of transporting another nucleic acid to which it has been linked. A vector, for example, can be a plasmid.

Nucleic acids referred to herein as "isolated" are nucleic acids separated away from the nucleic acids of the genomic DNA or cellular RNA of their source of origin (e.g., as it exists in cells or in a mixture of nucleic acids such as a library), and may have undergone further processing. "Isolated", as used herein, refers to nucleic or amino acid sequences that are at least 60% free, preferably 75% free, and most preferably 90% free from other components with which they are naturally associated. "Isolated" nucleic acids (polynucleotides) include nucleic acids obtained by methods described herein, similar methods or other suitable methods, including essentially pure nucleic acids, nucleic acids produced by chemical synthesis, by combinations of biological and chemical methods, and recombinant nucleic acids which are isolated. Nucleic acids referred to herein as "recombinant" are nucleic acids which have been produced by recombinant DNA methodology, including those nucleic acids that are generated by procedures which rely upon a method of artificial recombination, such as the polymerase chain reaction (PCR) and/or cloning into a vector using restriction enzymes. "Recombinant" nucleic acids are also those that result from recombination events that occur through the natural mechanisms of cells, but are selected for after the introduction to the cells of nucleic acids designed to allow or make probable a desired recombination event. Portions of the isolated nucleic acids which code for polypeptides having a certain function can be identified and isolated by, for example, the method of Jasin, M., et al., U.S. Pat. No. 4,952,501.

A further embodiment of the invention is antisense nucleic acids or oligonucleotides which are complementary, in whole or in part, to a target molecule comprising a sense strand, and can hybridize with the target molecule. The target can be DNA, or its RNA counterpart (i.e., wherein T residues of the DNA are U residues in the RNA counterpart). When introduced into a cell, antisense nucleic acids or oligonucleotides can inhibit the expression of the gene encoded by the sense strand or the mRNA transcribed from the sense strand. Antisense nucleic acids can be produced by standard techniques. See, for example, Shewmaker, et al., U.S. Pat. No. 5,107,065.

In a particular embodiment, an antisense nucleic acid or oligonucleotide is wholly or partially complementary to and can hybridize with a target nucleic acid (either DNA or RNA), wherein the target nucleic acid can hybridize to a nucleic acid having the sequence of the complement of the strand in SEQ ID NO:1, SEQ ID NO:2, SEQ ID NO:3, SEQ ID NO:4, SEQ ID NO:5, SEQ ID NO:6, SEQ ID NO:7, or SEQ ID NO:8. For example, an antisense nucleic acid or oligonucleotide can be complementary to a target nucleic acid having the sequence shown as the strand of the open reading frame of SEQ ID NO:1, SEQ ID NO:2, SEQ ID NO:3, SEQ ID NO:4, SEQ ID NO:5, SEQ ID NO:6, SEQ ID NO:7, or SEQ ID NO:8 or nucleic acid encoding a functional equivalent of Zmax7A, Zmax7B, Zmax8A, Zmax8B, Zmax20, Zmax61A, Zmax61B, or Zmax113, or to a portion of these nucleic acids sufficient to allow hybridization. A portion, for example, a sequence of 16 nucleotides could be sufficient to inhibit expression of the protein. Or, an antisense nucleic acid or oligonucleotide complementary to 5' or 3' untranslated regions, or overlapping the translation initiation codon (5' untranslated and translated regions), of the Zmax7A, Zmax7B, Zmax8A, Zmax8B, Zmax20, Zmax61A, Zmax61B, or Zmax113 gene, or a gene encoding a functional equivalent can also be effective. In another embodiment, the antisense nucleic acid is wholly or partially complementary to and can hybridize with a target nucleic acid which encodes a Zmax7A, Zmax7B, Zmax8A, Zmax8B, Zmax20, Zmax61A, Zmax61B, or Zmax113 polypeptide.

In addition to the antisense nucleic acids of the invention, oligonucleotides can be constructed which will bind to duplex nucleic acid either in the gene or the DNA:RNA complex of transcription, to form a stable triple helix-containing or triplex nucleic acid to inhibit transcription and/or expression of a gene encoding Zmax7A, Zmax7B, Zmax8A, Zmax8B, Zmax20, Zmax61A, Zmax61B, or Zmax113, or its functional equivalent. Frank-Kamenetskii, M. D. and Mirkin, S. M. (1995) *Ann. Rev. Biochem.* 64:65–95. Such oligonucleotides of the invention are constructed using the base-pairing rules of triple helix formation and the nucleotide sequence of the gene or mRNA for Zmax7A, Zmax7B, Zmax8A, Zmax8B, Zmax20, Zmax61A, Zmax61B, or Zmax113. These oligonucleotides can block Zmax7A, Zmax7B, Zmax8A, Zmax8B, Zmax20, Zmax61A, Zmax61B, or Zmax113-type activity in a number of ways, including prevention of transcription of the Zmax7A, Zmax7B, Zmax8A, Zmax8B, Zmax20, Zmax61A, Zmax61B, or Zmax113 gene or by binding to mRNA as it is transcribed by the gene.

The invention also relates to proteins or polypeptides encoded by the novel nucleic acids described herein. The proteins and polypeptides of this invention can be isolated and/or recombinant. Proteins or polypeptides referred to herein as "isolated" are proteins or polypeptides purified to a state beyond that in which they exist in cells. In a preferred embodiment, they are at least 10% pure; i.e., most preferably they are substantially purified to 80 or 90% purity. "Isolated" proteins or polypeptides include proteins or polypeptides obtained by methods described infra, similar methods or other suitable methods, and include essentially pure proteins or polypeptides, proteins or polypeptides produced by chemical synthesis or by combinations of biological and chemical methods, and recombinant proteins or polypeptides which are isolated. Proteins or polypeptides referred to herein as "recombinant" are proteins or polypeptides produced by the expression of recombinant nucleic acids.

In a preferred embodiment, the protein or portion thereof has at least one function characteristic of a Zmax7A, Zmax7B, Zmax8A, Zmax8B, Zmax20, Zmax61A, Zmax61B, or Zmax113 protein or polypeptide, for example, high bone mass activity in the case of Zmax61A or Zmax61B analogs, and/or antigenic function (e.g., binding of antibodies that also bind to naturally occurring Zmax61A or Zmax61B polypeptide). As such, these proteins are referred to as analogs, and include, for example, naturally occurring Zmax7A, Zmax7B, Zmax8A, Zmax8B, Zmax20, Zmax61A, Zmax61B, or Zmax113, variants (e.g. mutants) of those proteins and/or portions thereof. Such variants include mutants differing by the addition, deletion or substitution of one or more amino acid residues, or modified polypeptides in which one or more residues are modified, and mutants comprising one or more modified residues. The variant can have "conservative" changes, wherein a substituted amino acid has similar structural or chemical properties, e.g., replacement of leucine with isoleucine. More infrequently, a variant can have "nonconservative" changes, e.g., replacement of a glycine with a tryptophan. Guidance in determining which amino acid residues can be substituted, inserted, or deleted without abolishing biological or immunological activity can be found using computer programs well known in the art, for example, DNASTAR software (DNASTAR, Inc., Madison, Wis. 53715 U.S.A.).

A "portion" as used herein with regard to a protein or polypeptide, refers to fragments of that protein or polypeptide. The fragments can range in size from 5 amino acid residues to all but one residue of the entire protein sequence. Thus, a portion or fragment can be at least 5, 5–50, 50–100, 100–200, 200–400, 400–800, or more consecutive amino acid residues of a Zmax7A, Zmax7B, Zmax8A, Zmax8B, Zmax20, Zmax61A, Zmax61B, or Zmax113 protein or polypeptide, for example, SEQ ID NO:9, SEQ ID NO:10, SEQ ID NO:11, SEQ ID NO12, SEQ ID NO:13, SEQ ID NO:14, SEQ ID NO:15 or SEQ ID NO;16, or a variant thereof.

The invention also relates to isolated, synthesized and/or recombinant portions or fragments of a Zmax7A, Zmax7B, Zmax8A, Zmax8B, Zmax20, Zmax61A, Zmax61B, or Zmax113 protein or polypeptide as described above. Polypeptide fragments of the enzyme can be made which have full or partial function on their own, or which when mixed together (though fully, partially, or nonfunctional alone), spontaneously assemble with one or more other polypeptides to reconstitute a functional protein having at least one functional characteristic of a Zmax7A, Zmax7B, Zmax8A, Zmax8B, Zmax20, Zmax61A, Zmax61B, or Zmax113 protein of this invention.

The invention also concerns the use of the nucleotide sequence of the nucleic acids of this invention to identify DNA probes for Zmax7A, Zmax7B, Zmax8A, Zmax8B, Zmax20, Zmax61A, Zmax61B, or Zmax113 genes, PCR primers to amplify Zmax7A, Zmax7B, Zmax8A, Zmax8B, Zmax20, Zmax61A, Zmax61B, or Zmax113 genes, nucleotide polymorphisms in Zmax7A, Zmax7B, Zmax8A, Zmax8B, Zmax20, Zmax61A, Zmax61B, or Zmax113 genes, and regulatory elements of the Zmax7A, Zmax7B, Zmax8A, Zmax8B, Zmax20, Zmax61A, Zmax61B, or Zmax113 genes.

The Zmax7A, Zmax7B, Zmax8A, Zmax8B, Zmax20, Zmax61A, Zmax61B, or Zmax113 genes were isolated by narrowly defining the region of chromosome 11Q13.3 which was associated with high bone mass. The genes in this narrow area are also important in other diseases and thus, there was a need to identify and isolate all genes in the "high bone mass" (HBM) region.

Therefore, the chromosomal location 11q13.3 was refined by the addition of HBM genetic markers to the mapping panel used to map the gene, and by the extension of the pedigree to include more HBM individuals. The pedigree extension was critical because the new individuals that have been genotyped harbor critical recombination events that narrow the region. To identify genes in the region on 11q13.3, a set of BAC clones containing this chromosomal region was identified. The BAC clones served as a template for genomic DNA sequencing, and also as a reagent for identifying coding sequences by direct cDNA selection.

Genomic sequencing and direct cDNA selection were used to characterize more than 1.5 million base pairs of DNA from 11q13.3. The Zmax7A, Zmax7B, Zmax8A, Zmax8B, Zmax20, Zmax61A, Zmax61B, or Zmax113 genes were identified within this region.

When a gene was genetically localized to a specific chromosomal region, the genes in this region were characterized at the molecular level by a series of steps that included: cloning of the entire region of DNA in a set of overlapping clones (physical mapping), characterization of genes encoded by these clones by a combination of direct cDNA selection, exon trapping and DNA sequencing (gene identification), and identification of mutations in these genes by comparative DNA sequencing of affected and unaffected members of the HBM kindred (mutation analysis).

Physical mapping was accomplished by screening libraries of human DNA cloned in vectors that are propagated in *E. coli* or *S. cereviseae* using PCR assays designed to amplify unique molecular landmarks in the chromosomal region of interest. To generate a physical map of the HBM region, a library of human DNA cloned in Bacterial Artificial Chromosomes (BACs) was screened with a set of Sequence Tagged Site (STS) markers that had been previously mapped to chromosome 11q12–q13 by the efforts of the Human Genome Project.

STSs are unique molecular landmarks in the human genome that can be assayed by PCR. Thee location of thousands of STSs on the twenty-two autosomes and two sex chromosomes has been determined through the Human Genome Project. For a positional cloning effort, the physical map was tied to the genetic map because the markers used for genetic mapping can also be used as STSs for physical mapping. By screening a BAC library with a combination of STSs derived from genetic markers, genes, and random DNA fragments, a physical map comprised of overlapping clones representing all of the DNA in a chromosomal region of interest was assembled.

BACs are cloning vectors for large (80 kilobase to 200 kilobase) segments of human or other DNA that are propagated in *E. coli*. To construct a physical map using BACs, a library of BAC clones was screened so that individual clones harboring the DNA sequence corresponding to a given STS or set of STSs were identified. Throughout most of the human genome, the STS markers are spaced approximately 20 to 50 kilobases apart, so that an individual BAC clone typically contains at least two STS markers. In addition, the BAC libraries that were screened contain enough cloned DNA to cover the human genome six times over. Therefore, an individual STS typically identified more than one BAC clone. By screening a six-fold coverage BAC library with a series of STS markers spaced approximately 50 kilobases apart, a physical map consisting of a series of overlapping BAC clones, i.e. BAC contigs, were assembled for any region of the human genome. This map is closely tied to the genetic map because many of the STS markers used to prepare the physical map are also genetic markers.

When constructing a physical map, it often happens that there are gaps in the STS map of the genome that result in the inability to identify BAC clones that are overlapping in a given location. Typically, the physical map is first constructed from a set of STSs that have been identified through the publicly available literature and World Wide Web resources. The initial map consists of several separate BAC contigs that are separated by gaps of unknown molecular distance. To identify BAC clones that fill these gaps, it was necessary to develop new STS markers from the ends of the clones on either side of the gap. This was done by sequencing the terminal 200 to 300 base pairs of the BACs flanking the gap, and developing a PCR assay to amplify a sequence of 100 or more base pairs. If the terminal sequences are demonstrated to be unique within the human genome, then the new STS can be used to screen the BAC library to identify additional BACs that contain the DNA from the gap in the physical map. To assemble a BAC contig that covers a region the size of the HBM region (2,000,000 or more base pairs), it is often necessary to develop new STS markers from the ends of several clones.

After building a BAC contig, this set of overlapping clones served as a template for identifying the genes encoded in the chromosomal region. Gene identification can be accomplished by many methods. Three methods are commonly used: (1) a set of BACs selected from the BAC contig to represent the entire chromosomal region can be sequenced, and computational methods can be used to identify all of the genes, (2) the BACs from the BAC contig can be used as a reagent to clone cDNAs corresponding to the genes encoded in the region by a method termed direct cDNA selection, or (3) the BACs from the BAC contig can be used to identify coding sequences by selecting for specific DNA sequence motifs in a procedure called exon trapping. This invention includes genes identified by the first two methods.

To sequence the entire BAC contig representing the HBM region, a set of BACs was chosen for subcloning into plasmid vectors and subsequent DNA sequencing of these subclones. Since the DNA cloned in the BACs represents genomic DNA, this sequencing is referred to as genomic sequencing to distinguish it from cDNA sequencing. To initiate the genomic sequencing for a chromosomal region of interest, several non-overlapping BAC clones were chosen. DNA for each BAC clone was prepared, and the clones were sheared into random small fragments which were subsequently cloned into standard plasmid vectors such as pUC18. The plasmid clones were then grown to propagate the smaller fragments, and were used as templates for sequencing. To ensure adequate coverage and sequence quality for the BAC DNA sequence, sufficient plasmid clones were sequenced to yield six-fold coverage of the BAC clone. For example, if the BAC is 100 kilobases long, then phagemids were sequenced to yield 600 kilobases of sequence. Since the BAC DNA was randomly sheared prior to cloning in the phagemid vector, the 600 kilobases of raw DNA sequence were be assembled by computational methods into overlapping DNA sequences termed sequence contigs. For the purposes of initial gene identification by computational methods, six-fold coverage of each BAC was sufficient to yield ten to twenty sequence contigs of 1000 base pairs to 20,000 base pairs.

The sequencing strategy employed in this invention was to initially sequence "seed" BACs from the BAC contig in the HBM region. The sequence of the "seed" BACs was then used to identify minimally overlapping BACs from the contig, and these were subsequently sequenced. In this manner, the entire candidate region was sequenced, with several small sequence gaps left in each BAC. This sequence served as the template for computational gene identification. One method for computational gene identification was to compare the sequence of the BAC contig to publicly available databases of cDNA and genomic sequences, e.g. unigene, dbEST, genbank. These comparisons were typically done using the BLAST family of computer algorithms and programs (Altshul et al, *J. Mol. Biol.*, 215:403–410 (1990)). The BAC sequence was also translated into protein sequence, and the protein sequence was used to search publicly available protein databases, using a version of BLAST designed to analyze protein sequences (Altshul et al, *Nucl. Acids Res.*, 25:3389–3402 (1997)). Another method utilized computer algorithms such as MZEF (Zhang, *Proc. Natl. Acad. Sci.*, 94:565–568 (1997)) and GRAIL (Uberbacher et al, *Methods Enzymol.*, 266:259–281 (1996)), which predict the location of exons in the sequence based on the presence of specific DNA sequence motifs that are common to all exons, as well as the presence of codon usage typical of human protein encoding sequences.

In addition to identifying genes by computational methods, genes were also identified by direct cDNA selection (Del Mastro et al., *Genome Res.* 5(2):185–194 (1995)). In direct cDNA selection, cDNA pools from tissues of interest were prepared, and the BACs from the candidate region were used in a liquid hybridization assay to capture the cDNAs which base pair to coding regions in the BAC. In the methods described herein, the cDNA pools were created from several different tissues by random priming the first strand cDNA from polyA RNA, synthesizing the second strand cDNA by standard methods, and adding linkers to the ends of the cDNA fragments. The linkers are used to amplify the cDNA pools. The BAC clones were used as a template for in vitro DNA synthesis to create a biotin labelled copy of the BAC DNA. The biotin labelled copy of the BAC DNA was then denatured and incubated with an excess of the PCR amplified, Tinkered cDNA pools which were also denatured. The BAC DNA and cDNA were allowed to anneal in solution, and heteroduplexes between the BAC and the cDNA were isolated using streptavidin coated magnetic beads. The cDNAs that were captured by the BAC were then amplified using primers complimentary to the linker sequences, and the hybridization/selection process was repeated for a second round. After two rounds of direct cDNA selection, the cDNA fragments were cloned, and a library of these direct selected fragments were created.

The cDNA clones isolated by direct selection were analyzed by two methods. Since a pool of BACs from the HBM region was used to provide the genomic DNA sequence, the cDNAs were mapped to individual BACs. This was accomplished by arraying the BACs in microtiter dishes, and replicating their DNA in high density grids. Individual cDNA clones were then hybridized to the grid to confirm that they had sequence identity to an individual BAC from the set used for direct selection, and to determine the specific identity of that BAC. cDNA clones that were confirmed to correspond to individual BACs were sequenced. To determine whether the cDNA clones isolated by direct selection shared sequence identity or similarity to previously identified genes, the DNA and protein coding sequences were compared to publicly available databases using the BLAST family of programs.

The combination of genomic DNA sequence and cDNA sequence provided by BAC sequencing and by direct cDNA selection yielded an initial list of putative genes in the region. To further characterize each gene, Northern blots were performed to determine the size of the transcript corresponding to each gene, and to determine which putative exons were transcribed together to make an individual gene. For Northern blot analysis of each gene, probes were prepared from direct selected cDNA clones or by PCR amplifying specific fragments from genomic DNA or from the BAC encoding the putative gene of interest. The Northern blots gave information on the size of the transcript and the tissues in which it was expressed. For transcripts which were not highly expressed, it was sometimes necessary to perform a reverse transcription PCR assay using RNA from the tissues of interest as a template for the reaction.

Definitions

"Gene" refers to a DNA sequence that encodes through its template or messenger RNA a sequence of amino acids characteristic of a specific peptide. The term "gene" includes intervening, non-coding regions, as well as regulatory regions, and can include 5' and 3' ends.

The gene sequences of the present invention may be derived from a variety of sources including DNA, cDNA, synthetic DNA, synthetic RNA or combinations thereof. Such sequences may comprise genomic DNA which may or may not include naturally-occurring introns. Moreover, such genomic DNA may be obtained in association with promoter regions or poly (A) sequences. The sequences, genomic DNA or cDNA may be obtained in any of several ways. Genomic DNA can be extracted and purified from suitable cells by means well known in the art. Alternatively, mRNA can be isolated from a cell and used to produce cDNA by reverse transcription or other means.

"cDNA" refers to complementary or copy DNA produced from an RNA template by the action of RNA-dependent DNA polymerase (reverse transcriptase). Thus, a "cDNA clone" means a duplex DNA sequence complementary to an RNA molecule of interest, carried in a cloning vector or PCR amplified. This term includes genes from "Cloning" refers to the use of in vitro recombination techniques to insert a particular gene or other DNA sequence into a vector molecule. In order to successfully clone a desired gene, it is necessary to use methods for generating DNA fragments, for joining the fragments to vector molecules, for introducing the composite DNA molecule into a host cell in which it can replicate, and for selecting the clone having the target gene from amongst the recipient host cells.

"cDNA library" refers to a collection of recombinant DNA molecules containing cDNA inserts which together comprise the entire genome of an organism. Such a cDNA library can be prepared by methods known to one skilled in the art and described by, for example, Cowell and Austin, "cDNA Library Protocols," Methods in Molecular Biology (1997). Generally, RNA is first isolated from the cells of an organism from whose genome it is desired to clone a particular gene.

"Cloning vehicle" refers to a plasmid or phage DNA or other DNA sequence which is able to replicate in a host cell. The cloning vehicle is characterized by one or more endonuclease recognition sites at which such DNA sequences may be cut in a determinable fashion without loss of an essential biological function of the DNA, which may contain a marker suitable for use in the identification of transformed cells.

"Expression control sequence" refers to a sequence of nucleotides that control or regulate expression of structural genes when operably linked to those genes. These include, for example, the lac systems, the trp system, major operator and promoter regions of the phage lambda, the control region of fd coat protein and other sequences known to control the expression of genes in prokaryotic or eukaryotic cells. Expression control sequences will vary depending on whether the vector is designed to express the operably linked gene in a prokaryotic or eukaryotic host, and may contain transcriptional elements such as enhancer elements, termination sequences, tissue-specificity elements and/or translational initiation and termination sites.

"Expression vehicle" refers to a vehicle or vector similar to a cloning vehicle but which is capable of expressing a gene which has been cloned into it, after transformation into a host. The cloned gene is usually placed under the control of (i.e., operably linked to) an expression control sequence.

"Operator" refers to a DNA sequence capable of interacting with the specific repressor, thereby controlling the transcription of adjacent gene(s).

"Promoter" refers to a DNA sequence that can be recognized by an RNA polymerase. The presence of such a sequence permits the RNA polymerase to bind and initiate transcription of operably linked gene sequences.

"Promoter region" is intended to include the promoter as well as other gene sequences which may be necessary for the initiation of transcription. The presence of a promoter region is sufficient to cause the expression of an operably linked gene sequence.

"Operably linked" means that the promoter controls the initiation of expression of the gene. A promoter is operably linked to a sequence of proximal DNA if upon introduction into a host cell the promoter determines the transcription of the proximal DNA sequence(s) into one or more species of RNA. A promoter is operably linked to a DNA sequence if the promoter is capable of initiating transcription of that DNA sequence.

"Host" includes prokaryotes and eukaryotes, such as bacteria, yeast and filamentous fungi, as well as plant and animal cells. The term includes an organism or cell that is the recipient of a replicable expression vehicle.

"Amplification of nucleic acids" refers to methods such as polymerase chain reaction (PCR), ligation amplification (or ligase chain reaction, LCR) and amplification methods based on the use of Q-beta replicase. These methods are well known in the art and described, for example, in U.S. Pat. Nos. 4,683,195 and 4,683,202. Reagents and hardware for conducting PCR are commercially available. Primers useful for amplifying sequences from a specific chromosomal region are preferably complementary to, and hybridize specifically to sequences in a specific chromosomal region or in regions that flank a target region therein. The sequences generated by amplification may be sequenced directly. Alternatively, the amplified sequence(s) may be cloned prior to sequence analysis.

"Antibodies" may refer to polyclonal and/or monoclonal antibodies and fragments thereof, and immunologic binding equivalents thereof, that can bind to proteins and polypeptides, and fragments thereof. The term antibody is used both to refer to a homogeneous molecular entity, or a mixture such as a serum product made up of a plurality of different molecular entities. Proteins may be prepared synthetically in a protein synthesizer and coupled to a carrier molecule and injected over several months into rabbits. Rabbit sera is tested for immunoreactivity to the protein, polypeptide, or fragment. Monoclonal antibodies may be made by injecting mice with the proteins, polypeptides, or fragments thereof. Monoclonal antibodies will be screened by ELISA and tested for specific immunoreactivity with HBM protein or fragments thereof. Harlow et al, *Antibodies: A Laboratory Manual*, Cold Spring Harbor Laboratory, Cold Spring Harbor, N.Y. (1988). These antibodies will be useful in assays as well as pharmaceuticals. Antibody fragments can include Fa, F(ab')$_2$, and Fv, which are capable of binding the epitopic determinant.

"Humanized antibody", as used herein, refers to antibody molecules in which amino acids have been replaced in the non-antigen binding regions in order to more closely resemble a human antibody, while still retaining the original binding ability.

"Bone modulation" or "modulation of bone formation" refers to the ability to affect any of the physiological processes involved in bone remodeling, as will be appreciated by one skilled in the art, including, for example, bone resorption and appositional bone growth, by, inter alia, osteoclastic and osteoblastic activity, and may comprise some or all of bone formation and development as used herein.

"Normal bone density" refers to a bone density within two standard deviations of a Z score of 0.

Phenotyping Using DXA Measurements

Spinal bone mineral content (BMC) and bone mineral density (BMD) measurements performed at Creighton University (Omaha, Nebr.) were made by DXA using a Norland Instruments densitometer (Norland XR2600 Densitometer, Dual Energy X-ray Absorptiometry, DXA). Spinal BMC and BMD at other locations used the machinery available. There are estimated to be 800 DXA machines currently operating in the U.S. Most larger cities have offices or imaging centers which have DXA capabilities, usually a Lunar or Hologic machine. Each location that provided spine BMC and BMD data included copies of the printouts from their machines to provide verification that the regions of interest for measurement of BMD have been chosen appropriately. Complete clinical histories and skeletal radiographs were obtained.

The HBM (high bone mass) phenotype is defined by the following criteria: very high spinal BMD; a clinical history devoid of any known high bone mass syndrome; and skeletal radiographs showing a normal shape of the appendicular skeleton.

Genotyping of Microsatellite Markers

Figure 2A:
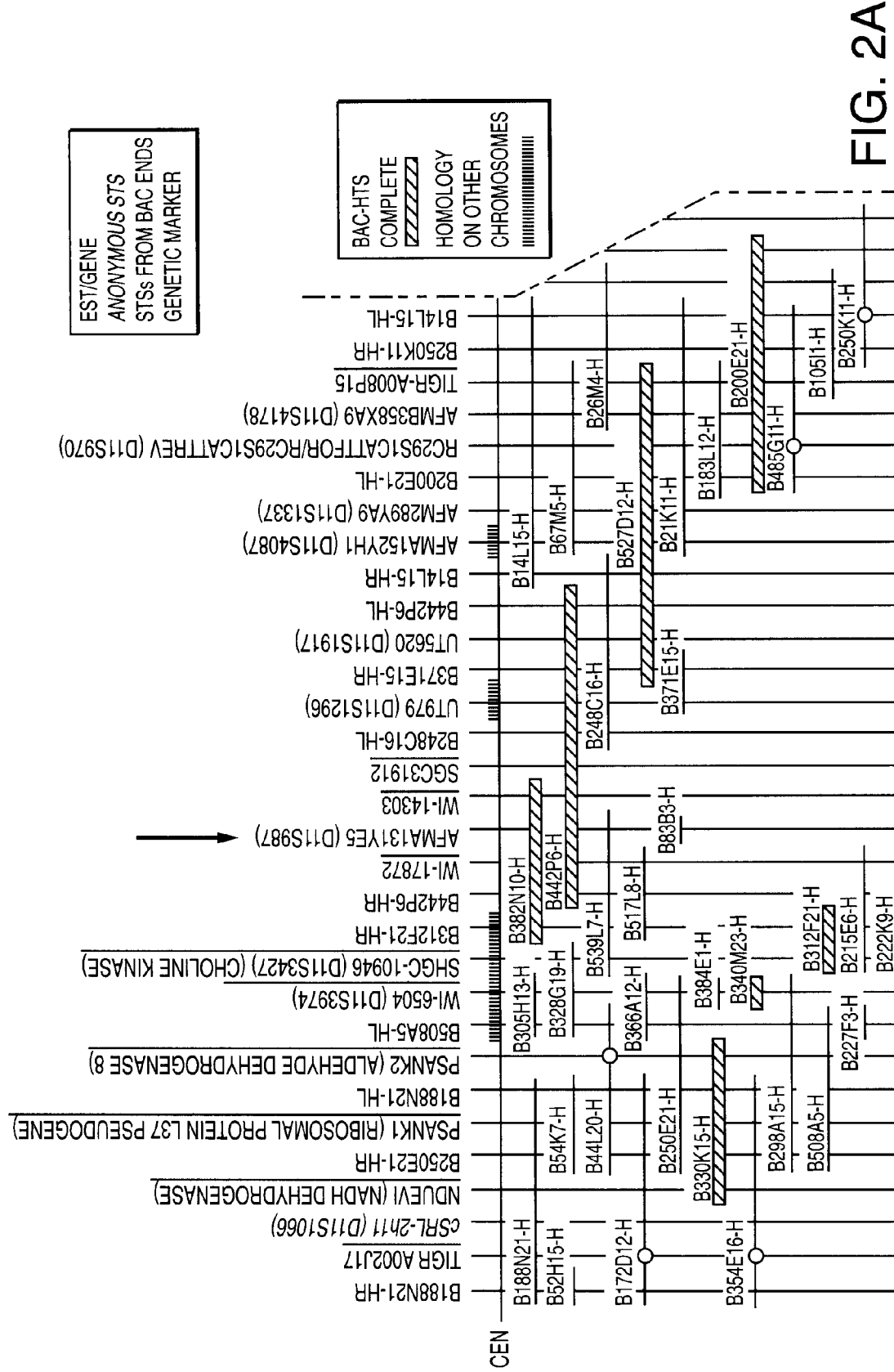
FIGS. 2A–2B depicts the BAC/STS content physical map of the HBM region in 11q13.3. STS markers derived from genes, ESTs, microsatellites, random sequences, and BAC endsequences are denoted above the long horizontal line. For markers that are present in GDB the same nomenclature has been used. Locus names (D11S####) are listed in parentheses after the primary name if available. STSs derived from BAC endsequences are listed with the BAC name first followed by L or R for the left and right end of the clone, respectively. The two large arrows indicate the genetic markers that define the HBM critical region. The horizontal lines below the STSs indicate BAC clones identified by PCR-based screening of a nine-fold coverage BAC library. Open circles indicate that the marker did not amplify the corresponding BAC library address during library screening. Clone names use the following convention: B for BAC, the plate, row and column address, followed by -H indicating the HBM project (i.e., B36F16-H).
Figure 2B:
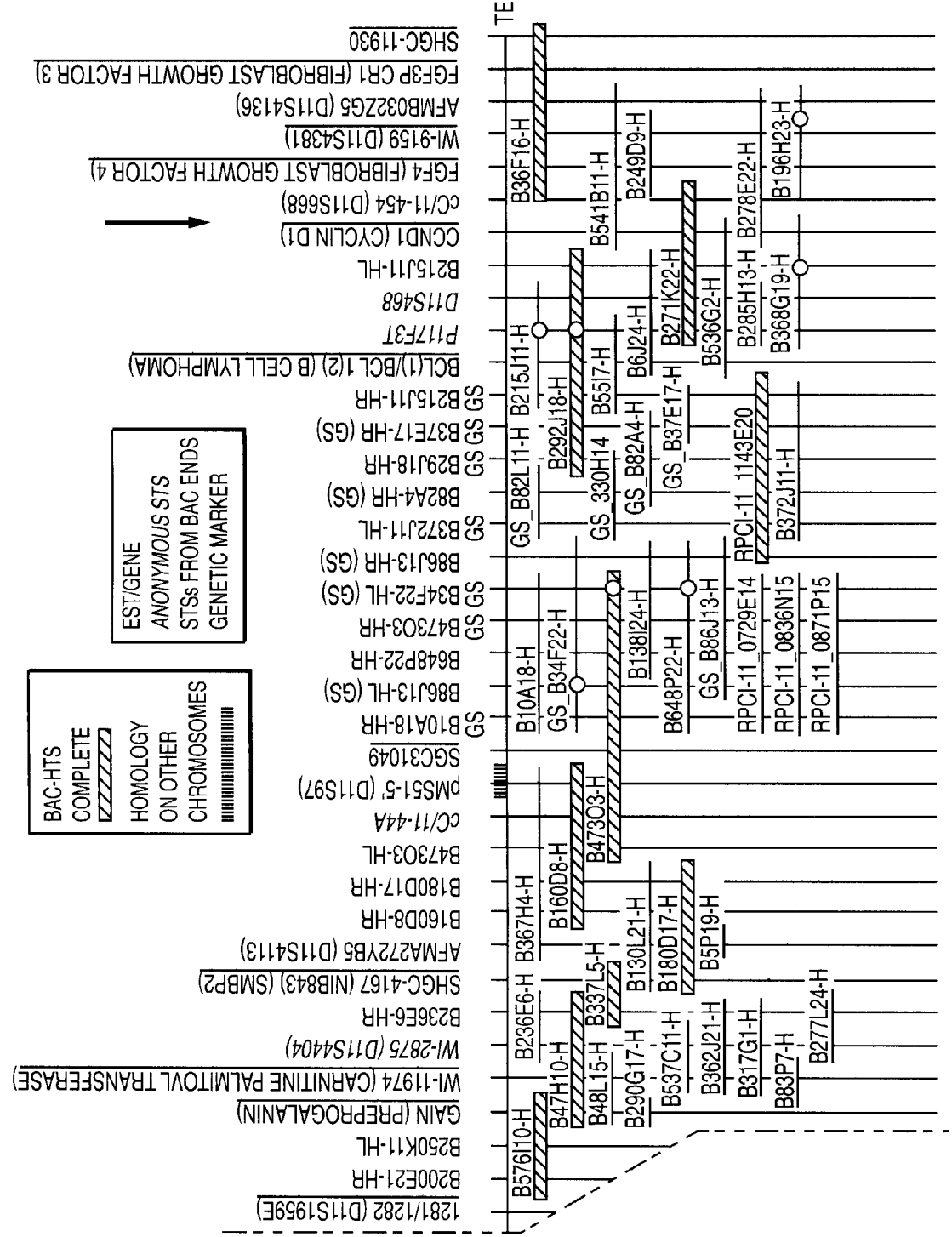
Figure 10:
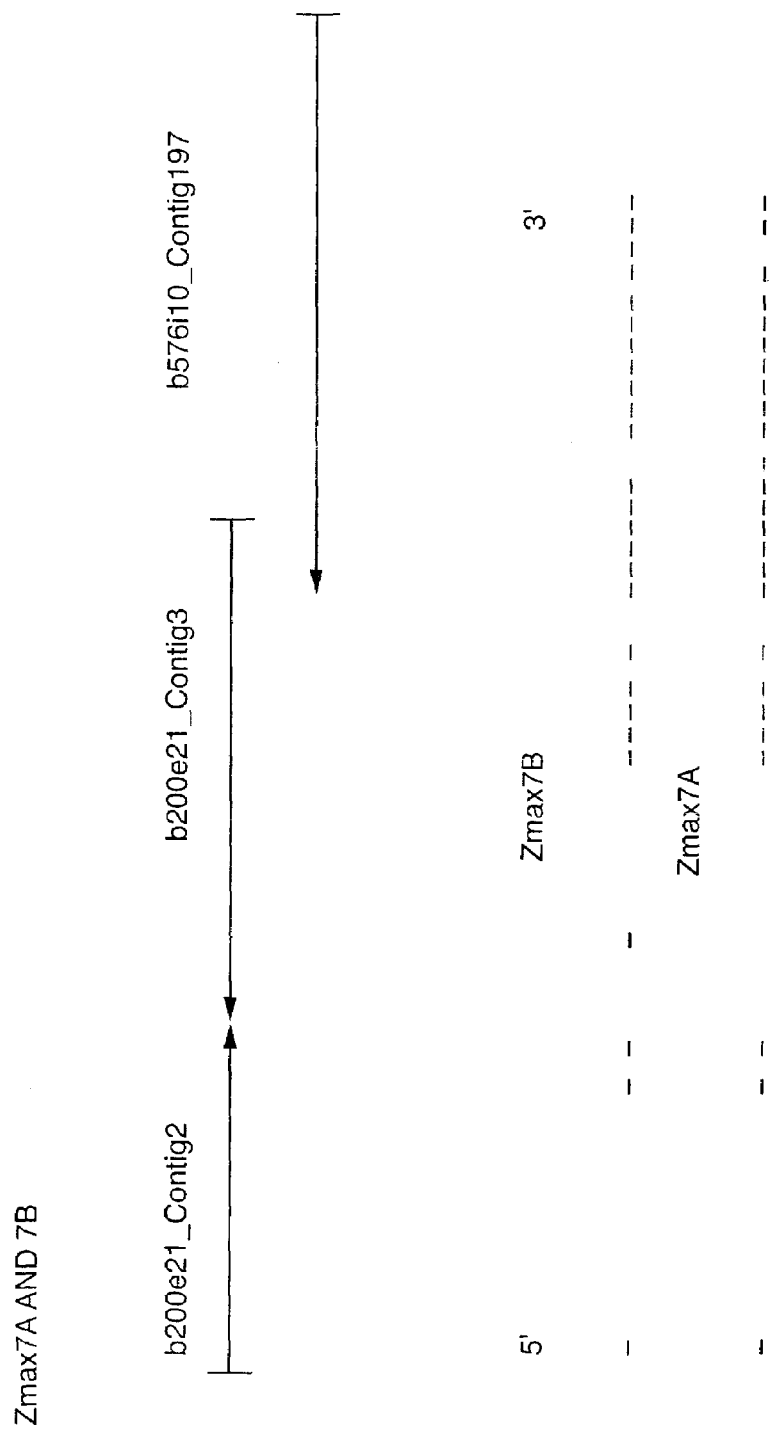
FIG. 10 is a schematic illustration of the BAC b200e21 and b576i10 in relation to the Zmax7A and Zmax7B genes.
Figure 11:
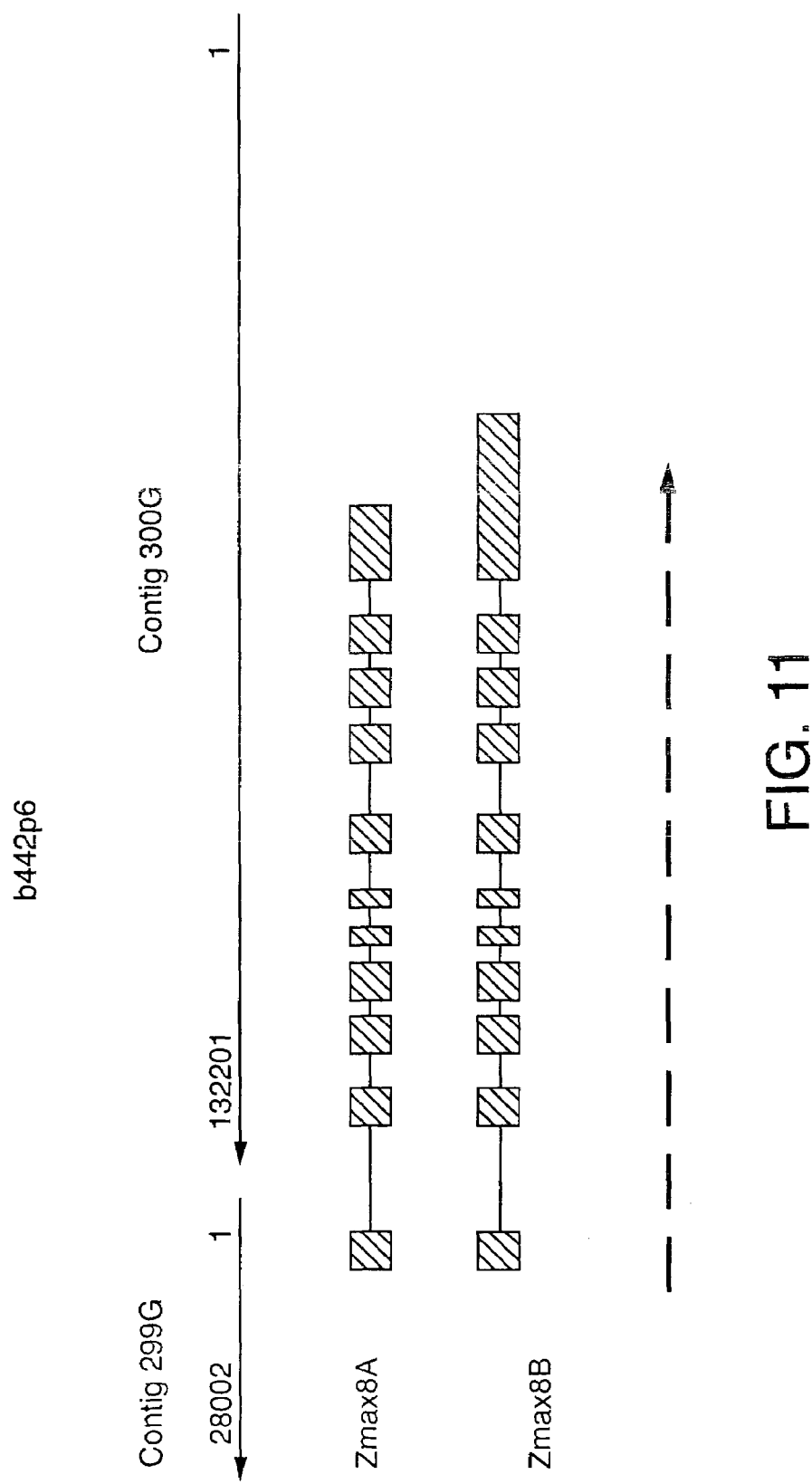
FIG. 11 is a schematic illustration of the BAC b442p6 in relation to the Zmax8A and Zmax8B genes.
Figure 12:
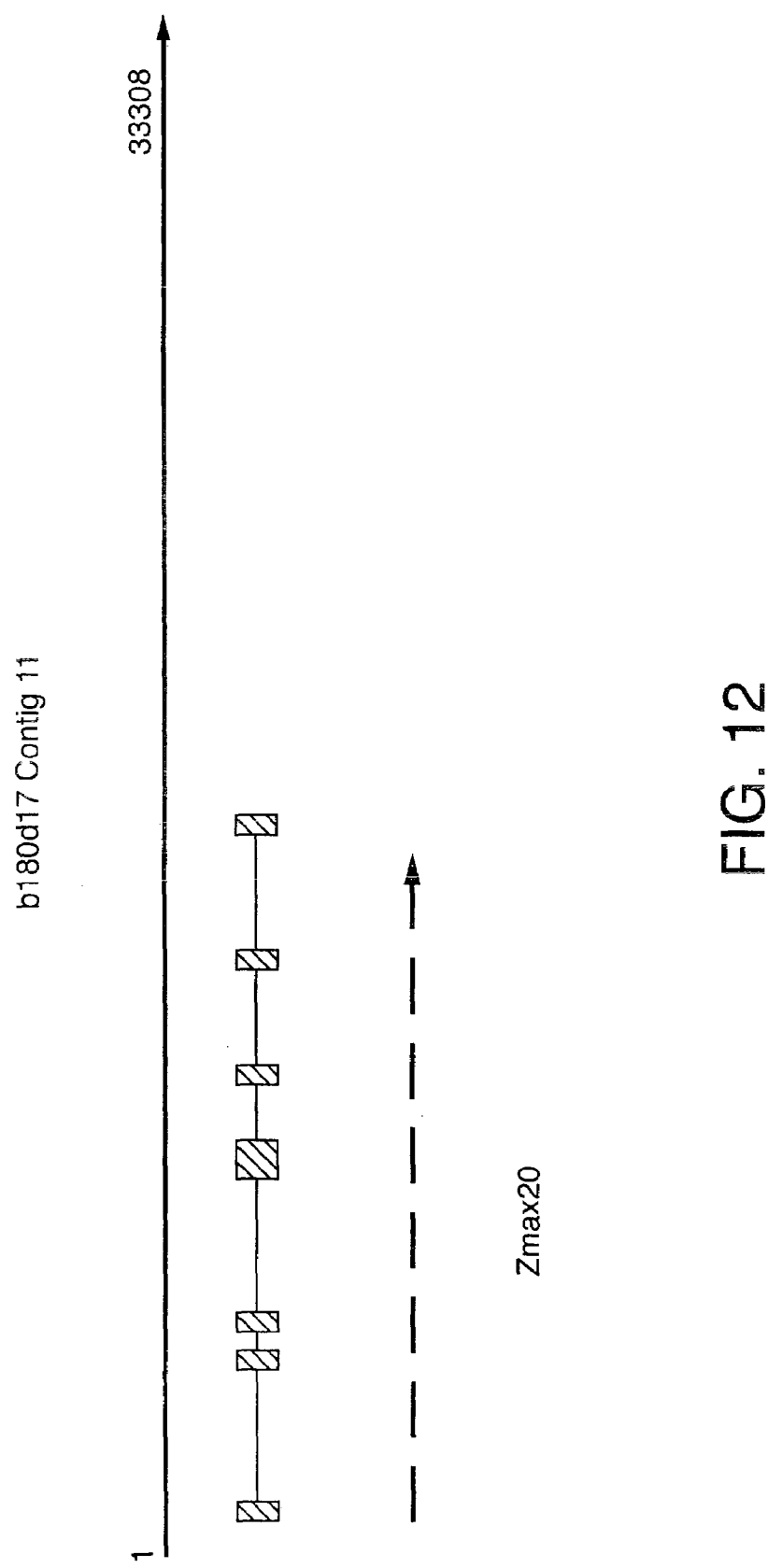
FIG. 12 is a schematic illustration of the BAC b180d17 in relation to the Zmax20 gene.
Figure 13:
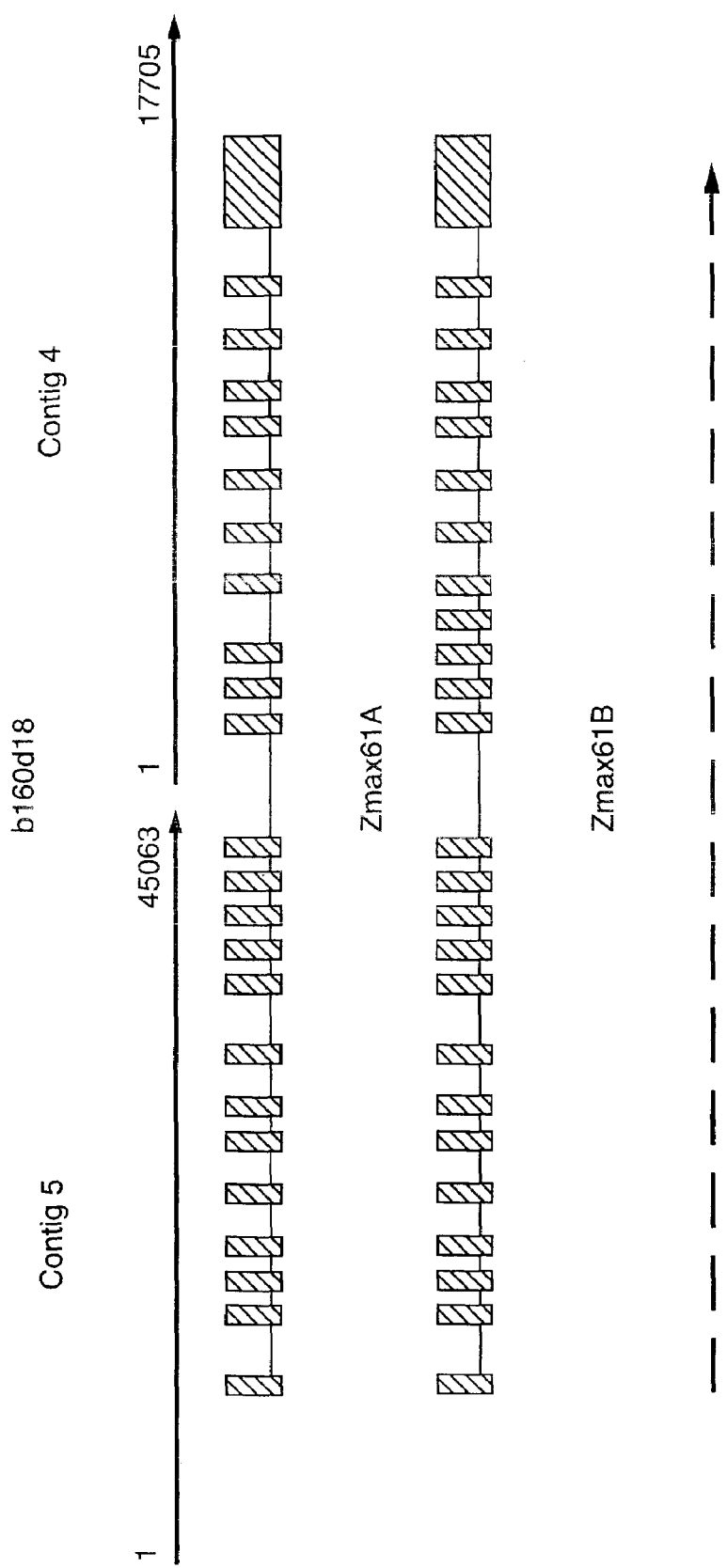
FIG. 13 is a schematic illustration of the BAC b160d8 in relation to the Zmax61A and Zmax61B gene.
Figure 14:
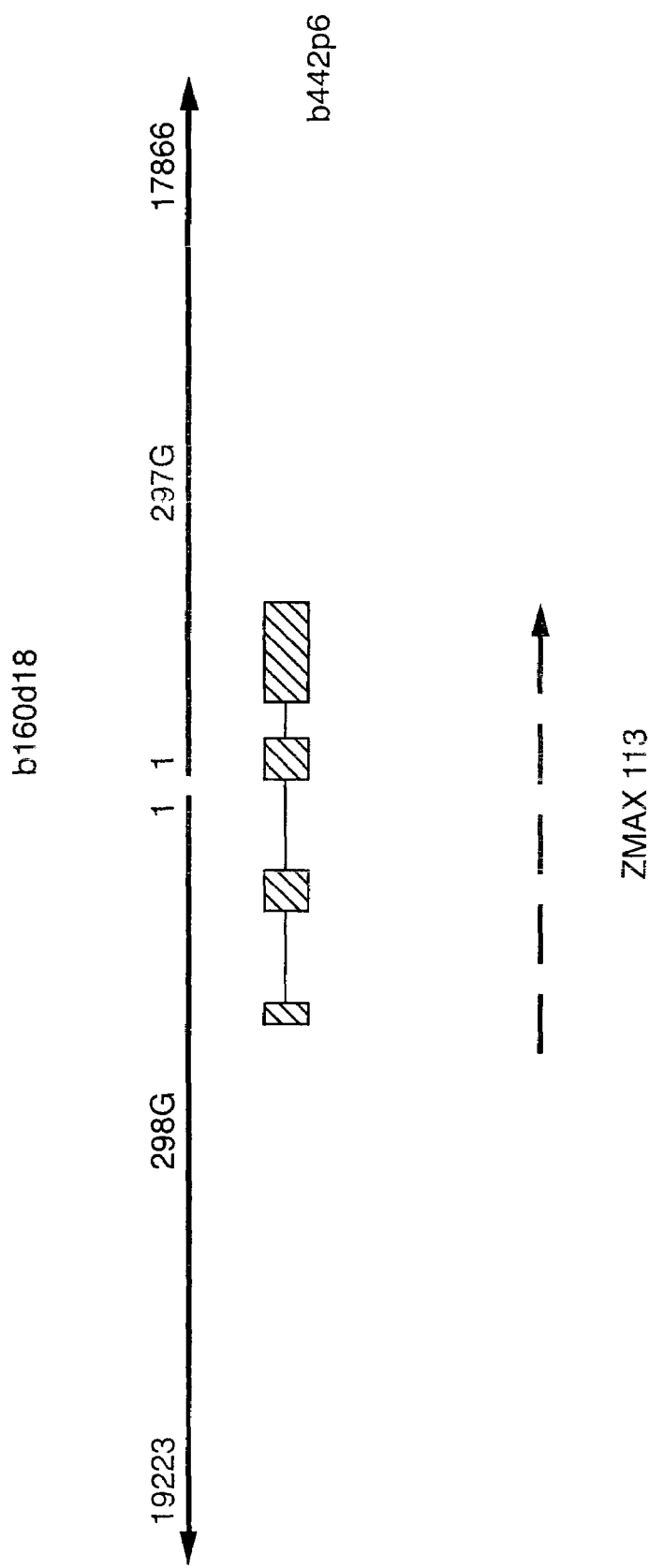
FIG. 14 is a schematic illustration of the BAC b442p6 in relation to the Zmax113 gene.

To narrow the genetic interval to a region smaller than that originally reported by Johnson et al, *Am. J. Hum. Genet.*, 60:1326–1332 (1997), additional microsatellite markers on chromosome 11q12–13 were typed. The new markers included: D11S4191, D11S1883, D11S1785, D11S4113, D11S4136, D11S4139, (Dib, et al, *Nature*, 380:152–154 (1996), FGF3 (Polymeropolous, et al, *Nucl. Acid Res.*, 18:7468 (1990)), as well as GTC_HBM_Marker_1, GTC_HBM_Marker_2, GTC_HBM_Marker_3, GTC_HBM_Marker_4, GTC_HBM_Marker_5, GTC_HBM_Marker_6, and GTC_HBM_Marker_7 (FIG. 2).

Blood (20 ml) was drawn into lavender cap (EDTA containing) tubes by a certified phlebotomist. The blood was stored refrigerated until DNA extraction. DNA has been extracted from blood stored for up to 7 days in the refrigerator without reduction in the quality or quantity of yield. For those subjects that have blood drawn at distant sites, a shipping protocol was successfully used on more than a dozen occasions. Blood samples were shipped by overnight express in a styrofoam container with freezer packs to provide cooling. Lavender cap tubes were placed on individual plastic shipping tubes and then into "zip-lock" biohazard bags. When the samples arrived the next day, they were immediately processed to extract DNA.

The DNA extraction procedure used a kit purchased from Gentra Systems, Inc. (Minneapolis, Minn.). Briefly, the procedure involved adding 3 volumes of a red blood cell lysis buffer to the whole blood. After incubations for 10 minutes at room temperature, the solution was centrifuged in a Beckman tabletop centrifuge at 2,000×g for 10 minutes. The white blood cell pellet was resuspended in Cell Lysis Buffer. Once the pellet was completely resuspended and free of cell clumps, the solution was digested with RNase A for 15 minutes at 37° C. Proteins were precipitated by addition of the provided Protein Precipitation Solution and removed by centrifugation. The DNA was precipitated out of the supernatant by addition of isopropanol. The yield of DNA was routinely >8 mg for a 20 ml sample of whole blood and had a MW of >50 kb. DNA was archived by storing coded 50 μg aliquots at −80° C. as an ethanol precipitate.

DNA was genotyped using one fluorescently labeled oligonucleotide primer and one unlabeled oligonucleotide primer. Labeled and unlabeled oligonucleotides were obtained from Integrated DNA Technologies, Inc. (Coralville, Iowa). All other reagents for microsatellite genotyping were purchased from Perkin Elmer-Applied Biosystems, Inc. ("PE-ABI") (Norwalk, Conn.). Individual PCR reactions were performed for each marker, as described by PE-ABI using AmpliTaq DNA Polymerase. The reactions were added to 3.5 μl of loading buffer containing deionized formamide, blue dextran and TAMRA 350 size standards (PE-ABI). After heating at 95° C. for 5 minutes to denature the DNA, the samples were loaded and electrophoresed as described in the operator's manual for the Model 377 DNA Sequencer (PE-ABI, Foster City, Calif.). After gel electrophoresis, the data was analyzed using PE-ABI GENESCAN™ and GENOTYPER™ software. First, within the GENESCAN™ software, the lane tracking was manually optimized prior to the first step of analysis. After the gel lane data was extracted, the standard curve profiles of each lane were examined and verified for linearity and size calling. Lanes which had problems with either of these parameters were re-tracked and verified. Once all lanes were tracked and the size standards were correctly identified, the data were imported into GENOTYPER™ for allele identification To expedite allele calling (binning), the program Linkage Designer from the Internet web-site of Dr. Guy Van Camp (http://alt.www.uia.ac.be/u/dnalab/Id.html) was used. This program greatly facilitates the importing of data generated by GENOTYPER™ into the pedigree drawing program Cyrillic (Version 2.0, Cherwell Scientific Publishing Limited, Oxford, Great Britain) and subsequent linkage analysis using the program LINKAGE (Lathrop et al, *Am. J. Hu. Genet.*, 37:482–498 (1985)).

Linkage Analysis

Linkage analysis was performed by typing all members of an affected (high bone mass) family at a given marker locus and evaluating the co-inheritance of a particular disease state with the marker probe, thereby determining how often the two of them are co-inherited. The recombination frequency was used as a measure of the genetic distance between two gene loci. A recombination frequency of 1% is equivalent to 1 map unit, or 1 centiMorgan (cM), which is roughly equivalent to 1,000 kb of DNA. This relationship holds up to frequencies of about 20% or 20 cM.

Figure 1B:
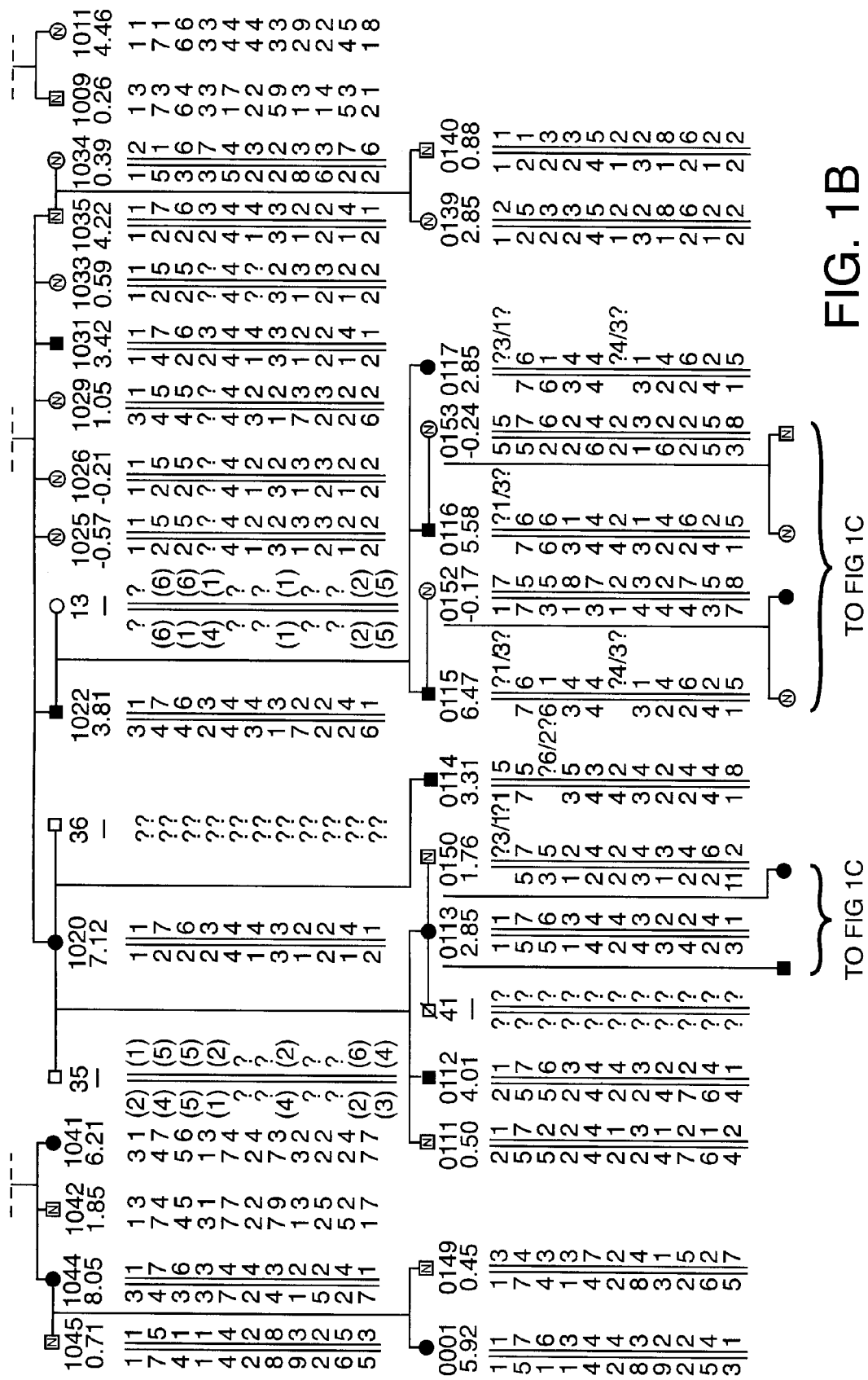

FIG. 1 demonstrates the pedigree of the individuals used in the genetic linkage studies for this invention. Specifically, two-point linkage analysis was performed using the MLINK and LINKMAP components of the program LINKAGE (Lathrop et al, *Am. J. Hu. Genet.*, 37:482–498 (1985)). Pedigree/marker data was exported from Cyrillic as a pre-file into the Makeped program and converted into a suitable ped-file for linkage analysis.

The original linkage analysis was performed using three models: (i) an autosomal dominant, fully penetrant model, (ii) an autosomal dominant model with reduced penetrance, and (iii) a quantitative trait model. The HBM region was mapped to chromosome 11q12–13 by analyzing DNA for linked markers from 22 members of a large, extended kindred. A highly automated technology was used with a panel of 345 fluorescent markers which spanned the 22 autosomes at a spacing interval ranging from 6–22 cM. Only markers from this region of chromosome 11 showed evidence of linkage (LOD score ~3.0). The highest LOD score (5.74) obtained by two-point and multipoint analysis was D11S987 (map position 55). The 95% confidence interval placed the HBM region between markers D11S905 and D11S937 (map position 41–71). Haplotype analysis also places Zmax7A, Zmax7B, Zmax8A, Zmax8B, Zmax20, Zmax61A, Zmax61B, or Zmax113 genes in this same region. Further descriptions of the markers D11S987, D11S905, and D11S937 can be found in Gyapay et al, *Nature Genetics*, Vol. 7, (1994).

The HBM interval was narrowed to the region between markers D11S987 and GTC_HBM_Marker_5. These two markers lie between the delimiting markers from the original analysis (D11S11S905 and D11S937) and are approximately 3 cM from one another. The narrowing of the interval was accomplished using genotypic data from the markers D11S4191, D11S1883, D11S1785, D11S4113, D11S4136, D11S4139, (Dib et al, *Nature*, 380:152–154 (1996)), FGF3 (Polymeropolous et al, *Nucl. Acid Res.*, 18:7468 (1990)) (information about the genetic markers can be found at the internet site of the Genome Database, http://gdbwww.gdb.org/), as well as the markers GTC_HBM_Marker_1, GTC_HBM_Marker_2, GTC_HBM_Marker_3, GTC_HBM_Marker_4, GTC_HBM_Marker_5, GTC_HBM_Marker_6, and GTC_HBM_Marker_7.

As shown in FIG. 1, haplotype analysis with the above genetic markers identified recombination events (crossovers) in individuals 9019 and 9020 that significantly refine the interval of chromosome 11 to which the Zmax7A, Zmax7B, Zmax8A, Zmax8B, Zmax20, Zmax61A, Zmax61B, or Zmax113 genes are localized. Individual 9019 is an HBM-affected individual that inherits a portion of chromosome 11 from the maternal chromosome with the HBM phenotype, and a portion from the chromosome 11 homologue. The portion inherited from the affected gene-carrying chromosome includes markers D11S935, D11S1313, GTC_HBM_Marker_4, D11S987, D11S1296, GTC_HBM_Marker_6, GTC_HBM_Marker_2, D11S970, GTC_HBM_Marker_3, D11S4113, GTC_HBM_Marker_1, GTC_HBM_Marker_7 and GTC_HBM_Marker_5. The portion from D11S4136 and continuing in the telomeric direction is derived from the non-HBM chromosome. Individual 9020 is an unaffected individual who also exhibits a critical recombination event. This individual inherits a recombinant paternal chromosome 11 that includes markers D11S935, D11S1313, GTC_HBM_Marker_4, D11S987, D11S1296 and GTC_HBM_Marker_6 from her father's (individual 0115) chromosome 11 homologue that carries affected phenotype and markers GTC_HBM_Marker_2, D11S970, GTC_HBM_Marker_3, GTC_HBM_Marker_1, GTC_HBM_Marker_7, GTC_HBM_Marker_5, D11S4136, D11S4139, D11S1314, and D11S937 from her father's chromosome 11 that does not carry the affected phenotype gene. Marker D11S4113 is uninformative due to its homozygous nature in individual 0115. This recombination event placed the centromeric boundary of the HBM region between markers D11S1296 and D11S987.

Two-point linkage analysis was also used to confirm the location of the HBM gene on chromosome 11. The linkage results for two point linkage analysis under a model of full penetrance are presented in Table 1 below. This table lists the genetic markers in the first column and the recombination fractions across the top of the table. Each cell of the column shows the LOD score for an individual marker tested for linkage to HBM region at the recombination fraction shown in the first row. For example, the peak LOD score of 7.66 occurs at marker D11S970, which is within the interval defined by haplotype analysis.

TABLE 1

| Marker | 0.0 | 0.05 | 0.1 | 0.15 | 0.2 | 0.25 | 0.3 | 0.35 | 0.4 |
| --- | --- | --- | --- | --- | --- | --- | --- | --- | --- |
| D11S935 | - infinity | 0.39 | 0.49 | 0.47 | 0.41 | 0.33 | 0.25 | 0.17 | 0.10 |
| D11S1313 | - infinity | 2.64 | 2.86 | 2.80 | 2.59 | 2.30 | 1.93 | 1.49 | 1.00 |
| D11S987 | - infinity | 5.49 | 5.18 | 4.70 | 4.13 | 3.49 | 2.79 | 2.03 | 1.26 |
| D11S4113 | 4.35 | 3.99 | 3.62 | 3.24 | 2.83 | 2.40 | 1.94 | 1.46 | 0.97 |
| D11S1337 | 2.29 | 2.06 | 1.81 | 1.55 | 1.27 | 0.99 | 0.70 | 0.42 | 0.18 |
| D11S970 | 7.66 | 6.99 | 6.29 | 5.56 | 4.79 | 3.99 | 3.15 | 2.30 | 1.44 |
| D11S4136 | 6.34 | 5.79 | 5.22 | 4.61 | 3.98 | 3.30 | 2.59 | 1.85 | 1.11 |
| D11S4139 | 6.80 | 6.28 | 5.73 | 5.13 | 4.50 | 3.84 | 3.13 | 2.38 | 1.59 |
| FGF3 | 0.59 | 3.23 | 3.15 | 2.91 | 2.61 | 2.25 | 1.84 | 1.40 | 0.92 |
| D11S1314 | 6.96 | 6.49 | 5.94 | 5.34 | 4.69 | 4.01 | 3.27 | 2.49 | 1.67 |
| D11S937 | - infinity | 4.98 | 4.86 | 4.52 | 4.06 | 3.51 | 2.88 | 2.20 | 1.47 |

The kindred described have several features of great interest, the most important being that their bones, while very dense, have an absolutely normal shape. The outer dimensions of the skeletons of the HBM-affected individuals are normal, and, while medullary cavities are present, there is no interference with hematopoiesis. The HBM-affected members seem to be resistant to fracture, and there are no neurologic symptoms, and no symptoms of impairment of any organ or system function in the members examined. HBM-affected members of the kindred live to advanced age without undue illness or disability. Furthermore, the HBM phenotype matches no other bone disorders such as osteoporosis, osteoporosis pseudoglioma, Engelmann's disease, Ribbing's disease, hyperphosphatasemia, Van Buchem's disease, melorheostosis, osteopetrosis, pycnodysostosis, sclerostenosis, osteopoikilosis, acromegaly, Paget's disease, fibrous dysplasia, tubular stenosis, osteogenesis imperfecta, hypoparathyroidism, pseudohypoparathyroidism, pseudopseudohypoparathyroidism, primary and secondary hyperparathyroidism and associated syndromes, hypercalciuria, medullary carcinoma of the thyroid gland, osteomalacia and other diseases. Clearly, the genes in this region have a very powerful and substantial role in regulating bone density, and its identification is an important step in understanding the pathway(s) that regulate bone density and the pathogenesis of diseases such as osteoporosis. Further, the genes in this region appear to be associated with other disorders and diseases as described supra.

Physical Mapping

To provide reagents for the cloning and characterization of the genes of the HBM region, the genetic mapping data described above were used to construct a physical map of the region containing Zmax7A, Zmax7B, Zmax8A, Zmax8B, Zmax20, Zmax61A, Zmax61B, or Zmax113 on chromosome 11q13.3. The physical map consists of an ordered set of molecular landmarks, and a set of BAC clones that contain the Zmax7A, Zmax7B, Zmax8A, Zmax8B, Zmax20, Zmax61A, Zmax61B, or Zmax113 genes from chromosome 11q13.3. Various publicly available mapping resources were utilized to identify existing STS markers (Olson et al, Science, 245:1434–1435 (1989)) in the HBM region. Resources included the GDB, the Whitehead Institute Genome Center, dbSTS and dbEST (NCBI), 11 db, the University of Texas Southwestern GESTEC, the Stanford Human Genome Center, and several literature references (Courseaux et al, Genomics, 40:13–23 (1997), Courseaux et al, Genomics, 37:354–365 (1996), Guru et al, Genomics, 42:436–445 (1997), Hosoda et al, Genes Cells, 2:345–357 (1997), James et al, Nat. Genet., 8:70–76 (1994), Kitamura et al, DNA Research, 4:281–289 (1997), Lemmens et al, Genomics, 44:94–100 (1997), Smith et al, Genome Res., 7:835–842 (1997)). Maps were integrated manually to identify markers mapping to the HBM region.

Primers for existing STSs were obtained from the GDB or literature references. Novel STSs were developed either from publicly available genomic sequence or from sequence-derived BAC insert ends. Primers were chosen using a script which automatically performs vector and repetitive sequence masking using Cross_match (P. Green, U. of Washington) and subsequent primer picking using Primer3 (Rozen, Skaletsky (1996, 1997). Primer3 is available at www.genome.wi.mit.edulgenome_software/other/primer3.html.

Polymerase chain reaction (PCR) conditions for each primer pair were initially optimized with respect to $MgCl_2$ concentration. The standard buffer was 10 mM Tris-HCl (pH 8.3), 50 mM KCl, $MgCl_2$, 0.2 mM each dNTP, 0.2 µM each primer, 2.7 ng/µl human DNA, 0.25 units of AmpliTaq (Perkin Elmer) and $MgCl_2$ concentrations of 1.0 mM, 1.5 mM, 2.0 mM or 2.4 mM. Cycling conditions included an initial denaturation at 94° C. for 2 minutes followed by 40 cycles at 94° C. for 15 seconds, 55° C. for 25 seconds, and 72° C. for 25 seconds followed by a final extension at 72° C. for 3 minutes. Depending on the results from the initial round of optimization the conditions were further optimized if necessary. Variables included increasing the annealing temperature to 58° C. or 60° C., increasing the cycle number to 42 and the annealing and extension times to 30 seconds, and using AmpliTaqGold (Perkin Elmer).

BAC clones (Kim et al, Genomics, 32:213–218 (1996), Shizuya et al, Proc. Natl. Acad. Sci. USA, 89:8794–8797 (1992)) containing STS markers of interest were obtained by PCR-based screening of DNA pools from a total human BAC library purchased from Research Genetics. DNA pools derived from library plates 1–596 were used corresponding to nine genomic equivalents of human DNA. The initial screening process involved PCR reactions of individual markers against superpools, i.e., a mixture of DNA derived from all BAC clones from eight 384-well library plates. For each positive superpool, plate (8), row (16) and column (24) pools were screened to identify a unique library address. PCR products were electrophoresed in 2% agarose gels (Sigma Chemical Company, St. Louis, Mo.) containing 0.5 µg/ml ethidium bromide in 1×TBE at 150 volts for 45 min. The electrophoresis units used were the Model A3-1 systems from Owl Scientific Products. Typically, gels contained 10 tiers of lanes with 50 wells/tier. Molecular weight markers (100 bp ladder, Life Technologies, Bethesda, Md.) were loaded at both ends of the gel. Images of the gels were captured with a Kodak DC40 CCD camera and processed with Kodak 1D software. The gel data were exported as tab delimited text files; names of the files included information about the library screened, the gel image files and the marker screened. These data were automatically imported using a customized Perl script into Filemaker™PRO (Claris Corp.) databases for data storage and analysis. In cases where incomplete or ambiguous clone address information was obtained, additional experiments were performed to recover a unique, complete library address.

Recovery of clonal BAC cultures from the library involved streaking out a sample from the library well onto LB agar (Maniatis et al, *Molecular Cloning: A Laboratory Manual.*, Cold Spring Harbor Laboratory, Cold Spring Harbor, N.Y. (1982)) containing 12.5 µg/ml chloramphenicol (Sigma). Two individual colonies and a portion of the initial streak quadrant were tested with appropriate STS markers by colony PCR for verification. Positive clones were stored in LB broth containing 12.5 µg/ml chloramphenicol and 15% glycerol at −70° C.

Several different types of DNA preparation methods were used for isolation of BAC DNA. The manual alkaline lysis miniprep protocol listed below (Maniatis et al, *Molecular Cloning: A Laboratory Manual*, Cold Spring Harbor Laboratory, Cold Spring Harbor, N.Y. (1982)) was successfully used for most applications, i.e., restriction mapping, CHEF gel analysis, FISH mapping, but was not reproducibly successful in endsequencing. The Autogen and Qiagen protocols were used specifically for BAC DNA preparation for endsequencing purposes.

Bacteria were grown in 15 ml Terrific Broth containing 12.5 µg/ml chloramphenicol in a 50 ml conical tube at 37° C. for 20 hrs with shaking at 300 rpm. The cultures were centrifuged in a Sorvall RT 6000 D at 3000 rpm (~1800 g) at 4° C. for 15 min. The supernatant was then aspirated as completely as possible. In some cases cell pellets were frozen at −20° C. at this step for up to 2 weeks. The pellet was then vortexed to homogenize the cells and minimize clumping. 250 µl of P1 solution (50 mM glucose, 15 mM Tris-HCl, pH 8, 10 mM EDTA, and 100 µg/ml RNase A) was added and the mixture pipetted up and down to mix. The mixture was then transferred to a 2 ml Eppendorf tube. 350 µl of P2 solution (0.2 N NaOH, 1% SDS) was then added, the mixture mixed gently and incubated for 5 min. at room temperature. 350 µl of P3 solution (3M KOAc, pH 5.5) was added and the mixture mixed gently until a white precipitate formed. The solution was incubated on ice for 5 min. and then centrifuged at 4° C. in a microfuge for 10 min. The supernatant was transferred carefully (avoiding the white precipitate) to a fresh 2 ml Eppendorf tube, and 0.9 ml of isopropanol was added, the solution mixed and left on ice for 5 min. The samples were centrifuged for 10 min., and the supernatant removed carefully. Pellets were washed in 70% ethanol and air dried for 5 min. Pellets were resuspended in 200 µl of TE8 (10 mM Tris-HCl, pH 8.0, 1.0 mM EDTA), and RNase A (Boehringer Mannheim) added to 100 µg/ml. Samples were incubated at 37° C. for 30 min., then precipitated by addition of $C_2H_3O_2Na3H_2O$ to 0.5 M and 2 volumes of ethanol. Samples were centrifuged for 10 min., and the pellets washed with 70% ethanol followed by air drying and dissolving in 50 µl TE8. Typical yields for this DNA prep were 3–5 µg/15 ml bacterial culture. Ten to 15 µl were used for HindIII restriction analysis; 5 µl was used for NotI digestion and clone insert sizing by CHEF gel electrophoresis.

BACs were inoculated into 15 ml of 2× LB Broth containing 12.5 µg/ml chloramphenicol in a 50 ml conical tube. 4 tubes were inoculated for each clone. Cultures were grown overnight (~16 hr) at 37° C. with vigorous shaking (>300 rpm). Standard conditions for BAC DNA isolation were followed as recommended by the Autogen 740 manufacturer. 3 ml samples of culture were placed into Autogen tubes for a total of 60 ml or 20 tubes per clone. Samples were dissolved finally in 100 µl TE8 with 15 seconds of shaking as part of the Autogen protocol. After the Autogen protocol was finished DNA solutions were transferred from each individual tube and pooled into a 2 ml Eppendorf tube. Tubes with large amounts of debris (carry over from the pelleting debris step) were avoided. The tubes were then rinsed with 0.5 ml of TE8 successively and this solution added to the pooled material. DNA solutions were stored at 4° C.; clumping tended to occur upon freezing at −20° C. This DNA was either used directly for restriction mapping, CHEF gel analysis or FISH mapping or was further purified as described below for use in endsequencing reactions.

The volume of DNA solutions was adjusted to 2 ml with TE8, samples were then mixed gently and heated at 65° C. for 10 min. The DNA solutions were then centrifuged at 4° C. for 5 min. and the supernatants transferred to a 15 ml conical tube. The NaCl concentration was then adjusted to 0.75 M (~3 ml of 5 M NaCl to the 2 ml sample). The total volume was then adjusted to 6 ml with Qiagen column equilibration buffer (Buffer QBT). The supernatant containing the DNA was then applied to the column and allowed to enter by gravity flow. Columns were washed twice with 10 ml of Qiagen Buffer QC. Bound DNA was then eluted with four separate 1 ml aliquots of Buffer QF kept at 65° C. DNA was precipitated with 0.7 volumes of isopropanol (~2.8 ml). Each sample was then transferred to 4 individual 2.2 ml Eppendorf tubes and incubated at room temperature for 2 hr or overnight. Samples were centrifuged in a microfuge for 10 min. at 4° C. The supernatant was removed carefully and 1 ml of 70% ethanol was added. Samples were centrifuged again and because the DNA pellets were often loose at this stage, the supernatant removed carefully. Samples were centrifuged again to concentrate remaining liquid which was removed with a micropipet tip. DNA pellets were then dried in a desiccator for 10 min. 20 µl of sterile distilled and deionized $H_2O$ was added to each tube which was then placed at 4° C. overnight. The four 20 µl samples for each clone were pooled and the tubes rinsed with another 20 µl of sterile distilled and deionized $H_2O$ for a final volume of 100 µl. Samples were then heated at 65° C. for 5 min. and then mixed gently. Typical yields were 2–5 µg/60 ml culture as assessed by NotI digestion and comparison with uncut lambda DNA.

3 ml of LB Broth containing 12.5 µg/ml of chloramphenicol was dispensed into autoclaved Autogen tubes. A single tube was used for each clone. For inoculation, glycerol stocks were removed from −70° C. storage and placed on dry ice. A small portion of the glycerol stock was removed from the original tube with a sterile toothpick and transferred into the Autogen tube; the toothpick was left in the Autogen tube for at least two minutes before discarding. After inoculation the tubes were covered with tape making sure the seal was tight. When all samples were inoculated, the tube units were transferred into an Autogen rack holder and placed into a rotary shaker at 37° C. for 16–17 hours at 250 rpm. Following growth, standard conditions for BAC DNA preparation, as defined by the manufacturer, were used to program the Autogen. Samples were not dissolved in TE8 as part of the program and DNA pellets were left dry. When the program was complete, the tubes were removed from the output tray and 30 µl of sterile distilled and deionized $H_2O$ was added directly to the bottom of the tube. The tubes were then gently shaken for 2–5 seconds and then covered with parafilm and incubated at room temperature for 1–3 hours. DNA samples were then transferred to an Eppendorf tube and used either directly for sequencing or stored at 4° C. for later use.

BAC Clone Characterization for Physical Mapping

DNA samples prepared either by manual alkaline lysis or the Autogen protocol were digested with HindIII for analysis of restriction fragment sizes. This data were used to compare the extent of overlap among clones. Typically 1–2 μg were used for each reaction. Reaction mixtures included: 1× Buffer 2 (New England Biolabs), 0.1 mg/ml bovine serum albumin (New England Biolabs), 50 μg/ml RNase A (Boehringer Mannheim), and 20 units of HindIII (New England Biolabs) in a final volume of 25 μl. Digestions were incubated at 37° C. for 4–6 hours. BAC DNA was also digested with NotI for estimation of insert size by CHEF gel analysis (see below). Reaction conditions were identical to those for HindIII except that 20 units of NotI were used. Six μl of 6× Ficoll loading buffer containing bromphenol blue and xylene cyanol was added prior to electrophoresis.

HindIII digests were analyzed on 0.6% agarose (Seakem, FMC Bioproducts) in 1× TBE containing 0.5 μg/ml ethidium bromide. Gels (20 cm×25 cm) were electrophoresed in a Model A4 electrophoresis unit (Owl Scientific) at 50 volts for 20–24 hrs. Molecular weight size markers included undigested lambda DNA, HindIII digested lambda DNA, and HaeIII digested X174 DNA. Molecular weight markers were heated at 65° C. for 2 min. prior to loading the gel. Images were captured with a Kodak DC40 CCD camera and analyzed with Kodak 1D software.

NotI digests were analyzed on a CHEF DRII (BioRad) electrophoresis unit according to the manufacturer's recommendations. Briefly, 1% agarose gels (BioRad pulsed field grade) were prepared in 0.5× TBE, equilibrated for 30 minutes in the electrophoresis unit at 14° C., and electrophoresed at 6 volts/cm for 14 hrs with circulation. Switching times were ramped from 10 sec to 20 sec. Gels were stained after electrophoresis in 0.5 μg/ml ethidium bromide. Molecular weight markers included undigested lambda DNA, HindIII digested lambda DNA, lambda ladder PFG ladder, and low range PFG marker (all from New England Biolabs, Inc., Beverly, Mass. 01915).

BAC DNA prepared either by the manual alkaline lysis or Autogen protocols were labeled for FISH analysis using a Bioprime labeling kit (BioRad, Inc., Hercules, Calif. 94547) according to the manufacturer's recommendation with minor modifications. Approximately 200 ng of DNA was used for each 50 μl reaction. 3 μl were analyzed on a 2% agarose gel to determine the extent of labeling. Reactions were purified using a Sephadex G50 spin column prior to in situ hybridization. Metaphase FISH was performed as described (Ma et al, *Cytogenet. Cell Genet.*, 74:266–271 (1996)).

BAC Endsequencing.

The sequencing of BAC insert ends utilized DNA prepared by either of the two methods described above. The DYEnarnic energy transfer primers and Dynamic Direct cycle sequencing kits from Amersham (Amersham Pharmacia Biotech, Inc., Piscataway, N.J. 08855-1327, U.S.A.) were used for sequencing reactions. Ready made sequencing mix including the M13-40 forward sequencing primer was used (Catalog # US79730) for the T7 BAC vector terminus; ready made sequencing mix (Catalog # US79530) was mixed with the M13-28 reverse sequencing primer (Catalog # US79339) for the SP6 BAC vector terminus. The sequencing reaction mixes included one of the four fluorescently labeled dye-primers, one of the four dideoxy termination mixes, dNTPs, reaction buffer, and Thermosequenase. For each BAC DNA sample, 3 μl of the BAC DNA sample was aliquoted to 4 PCR strip tubes. 2 μl of one of the four dye primer/termination mix combinations was then added to each of the four tubes. The tubes were then sealed and centrifuged briefly prior to PCR. Thermocycling conditions involved a 1 minute denaturation at 95° C., 15 second annealing at 45° C., and extension for 1 minute at 70° C. for 35 total cycles. After cycling the plates were centrifuged briefly to collect all the liquid to the bottom of the tubes. 5 μl of sterile distilled and deionized $H_2O$ was then added into each tube, the plates sealed and centrifuged briefly again. The four samples for each BAC were then pooled together. DNA was then precipitated by adding 1.5 μl of 7.5 M $NH_4OAc$ and 100 μl of −20° C. 100% ethanol to each tube. Samples were mixed by pipetting up and down once. The plates were then sealed and incubated on ice for 10 minutes. Plates were centrifuged in a table top Haraeus centrifuge at 4000 rpm (3,290 g) for 30 minutes at 4° C. to recover the DNA. The supernatant was removed and excess liquid blotted onto paper towels. Pellets were washed by adding 100 μl of −20° C. 70% ethanol into each tube and recentrifuging at 4000 rpm (3,290 g) for 10 minutes at 4° C. The supernatant was removed and excess liquid again removed by blotting on a paper towel. Remaining traces of liquid were removed by placing the plates upside down over a paper towel and centrifuging only until the centrifuge reached 800 rpm. Samples were then air dried at room temperature for 30 min. Tubes were capped and stored dry at −20° C. until electrophoresis. Immediately prior to electrophoresis the DNA was dissolved in 1.5 μl of Amersham loading dye (Amersham, supra). Plates were then sealed and centrifuged at 2000 rpm (825 g). The plates were then vortexed on a plate shaker for 1–2 minutes. Samples were then recentrifuged at 2000 rpm (825 g) briefly. Samples were then heated at 65° C. for 2 min. and immediately placed on ice. Standard gel electrophoresis was performed on ABI 377 fluorescent sequencers according to the manufacturer's recommendation.

Sub-Cloning and Sequencing of HBM BAC DNA

The physical map of the HBM gene region provided a set of BAC clones that contained within them the Zmax7A, Zmax 7B, Zmax 8A, Zmax8B Zmax 20, Zmax 61A Zmax61B, and Zmax 113 genes. DNA sequencing of several of the BACs from the HBM region was completed and produced novel nucleotide sequence data which was used to identify the Zmax7A, Zmax 7B, Zmax 8A, Zmax8B Zmax 20, Zmax 61A Zmax61B, and Zmax 113 genes directly, or to prepare probes for identification of these genes, or to detect DNA sequence polymorphisms which assisted in identifying these genes.

BAC DNA was isolated according to one of two protocols, either a Qiagen purification of BAC DNA as described in the product literature (Qiagen, Inc., Valencia, Calif., U.S.A.), or a manual purification which is a modification of the standard alkaline lysis/Cesium Chloride preparation of plasmid DNA (see e.g., Ausubel et al, *Current Protocols in Molecular Biology*, John Wiley & Sons (1997)). Briefly, for the manual protocol, cells were pelleted, resuspended in GTE (50 mM glucose, 25 mM Tris-Cl (pH 8), 10 mM EDTA) and lysozyme (50 mg/ml solution), followed by NaOH/SDS (1% SDS/0.2N NaOH) and then an ice-cold solution of 3M KOAc (pH 4.5–4.8). RnaseA was added to the filtered supernatant, followed by Proteinase K and 20% SDS. The DNA was then precipitated with isopropanol, dried and resuspended in TE (10 mM Tris, 1 mM EDTA (pH 8.0)). The BAC DNA was further purified by Cesium Chloride density gradient centrifugation (Ausubel et al., *Current Protocols in Molecular Biology*, John Wiley & Sons (1997)).

Following isolation, the BAC DNA was sheared hydrodynamically using an HPLC (Hengen, *Trends in Biochem. Sci.*, 22:273–274 (1997)) to an insert size of 2000–3000 bp. After shearing, the DNA was concentrated and separated on a standard 1% agarose gel. A single fraction, corresponding to the approximate size, was excised from the gel and purified by electroelution (Sambrook et al., *Molecular Cloning: A Laboratory Manual*, Cold Spring Harbor Laboratory, Cold Spring, N.Y. (1989)).

The purified DNA fragments were then blunt-ended using T4 DNA polymerase. The blunt-ended DNA was then ligated to unique BstXI-linker adapters (5' GTCTTCAC-CACGGGG (SEQ ID NO: 35) and 5' GTGGTGAAGAC (SEQ ID NO: 36) in 100–1000 fold molar excess). These linkers were complimentary to the constructed BstXI-cut pMPX vectors, while the overhang was not self-complimentary. Therefore, the linkers would not concatemerize nor would the cut-vector religate itself easily. The linker-adapted inserts were separated from the unincorporated linkers on a 1% agarose gel and purified using GeneClean (BIO 101, Inc., Vista, Calif. 92083 U.S.A.). The linker-adapted insert was then ligated to a modified pBlueScript vector to construct a "shotgun" subclone library. The vector contained an out-of-frame lacZ gene at the cloning site which became in-frame in the event that an adapter-dimer is cloned, allowing these to be avoided by their blue-color.

All subsequent steps were based on sequencing by ABI377 automated DNA sequencing methods (Perkin-Elmer Biosystems, Foster City, Calif. 94404, U.S.A.). Only major modifications to the protocols are highlighted. Briefly, the library was then transformed into DH5 competent cells (Life Technologies, Bethesda, Md., U.S.A.; DH5 transformation protocol). It was assessed by plating onto antibiotic plates containing ampicillin and IPTG/Xgal. The plates were incubated overnight at 37° C. Successful transformants were then used for plating of clones and picking for sequencing. The cultures were grown overnight at 37° C. DNA was purified using a silica bead DNA preparation (Ng et al., *Nucl. Acids Res.*, 24:5045–5047 (1996)) method. In this manner, 25 µg of DNA was obtained per clone.

These purified DNA samples were then sequenced using ABI dye-terminator chemistry. The ABI dye terminator sequence reads were run on ABI377 machines and the data was directly transferred to UNIX machines following lane tracking of the gels. All reads were assembled using PHRAP (P. Green, Abstracts of DOE Human Genome Program Contractor-Grantee Workshop V, January 1996, p. 157) with default parameters and quality scores. The initial assembly was done at 6-fold coverage and yielded an average of 8–15 contigs. Following the initial assembly, missing mates (sequences from clones that only gave one strand reads) were identified and sequenced with ABI technology (Perkin-Elmer Biosystems, supra) to allow the identification of additional overlapping contigs. Primers for walking were selected using a Genome Therapeutics program Pick_primer near the ends of the clones to facilitate gap closure. These walks were sequenced using the selected clones and primers. Data were reassembled with PHRAP into sequence contigs.

Gene Identification by Computational Methods

Following assembly of the BAC sequences into contigs, the contigs were subjected to computational analyses to identify coding regions and regions bearing DNA sequence similarity to known genes. This protocol included the following steps.

1. Degap the contigs: the sequence contigs often contain symbols (denoted by a period symbol) that represent locations where the individual ABI sequence reads have insertions or deletions. Prior to automated computational analysis of the contigs, the periods were removed. The original data was maintained for future reference.

2. BAC vector sequences were "masked" within the sequence by using the program cross match (Phil Green, http:\\chimera.biotech.washington.edu\UWGC). Since the shotgun libraries construction detailed above leaves some BAC vector in the shotgun libraries, this program was used to compare the sequence of the BAC contigs to the BAC vector and to mask any vector sequence prior to subsequent steps. Masked sequences were marked by an "X" in the sequence files, and remained inert during subsequent analyses.

3. *E. coli* sequences contaminating the BAC sequences were masked by comparing the BAC contigs to the entire *E. coli* DNA sequence.

4. Repetitive elements known to be common in the human genome were masked using cross match. In this implementation of crossmatch, the BAC sequence was compared to a database of human repetitive elements (Jerzy Jerka, Genetic Information Research Institute, Palo Alto, Calif.). The masked repeats were marked by X and remained inert during subsequent analyses.

5. The location of exons within the sequence was predicted using the MZEF computer program (Zhang, *Proc. Natl. Acad. Sci*, 94:565–568 (1997)).

6. The sequence was compared to the publicly available unigene database (National Center for Biotechnology Information, National Library of Medicine, 38A, 8N905, 8600 Rockville Pike, Bethesda, Md. 20894; www.ncbi.nlm.nih.gov) using the blastn2 algorithm (Altschul et al, *Nucl. Acids Res.*, 25:3389–3402 (1997)). The parameters for this search were: E=0.05, v=50, B=50 (where E is the expected probability score cutoff, V is the number of database entries returned in the reporting of the results, and B is the number of sequence alignments returned in the reporting of the results (Altschul et al, *J. Mol. Biol.*, 215:403–410 (1990)).

7. The sequence was translated into protein for all six reading frames, and the protein sequences were compared to a non-redundant protein database compiled from Genpept Swissprot PIR (National Center for Biotchnology Information, National Library of Medicine, 38A, 8N905, 8600 Rockville Pike, Bethesda, Md. 20894; www.ncbi.nlm.nih.gov). The parameters for this search were E=0.05, V=50, B=50, where E, V, and B are defined as above.

8. The BAC DNA sequence was compared to the database of the cDNA clones derived from direct selection experiments (described below) using blastn2 (Altschul et al., *Nucl. Acids. Res.*, 25:3389–3402 (1997)). The parameters for this search were E=0.05, V=250, B=250, where E, V, and B are defined as above.

9. The BAC sequence was compared to the sequences of all other BACs from the HBM region on chromosome 11q12–13 using blastn2 (Altschul et al., supra). The parameters for this search were E=0.05, V=50, B=50, where E, V, and B are defined as above.

10. The BAC sequence was compared to the sequences derived from the ends of BACs from the HBM region on chromosome 11q12–13 using blastn2 (Altschul et al., supra). The parameters for this search were E=0.05, V=50, B=50, where E, V, and B are defined as above.

11. The BAC sequence was compared to the Genbank database (National Center for Biotechnology Information, National Library of Medicine, 38A, 8N905, 8600 Rockville Pike, Bethesda, Md. 20894; www.ncbi.nlm.nih.gov) using blastn2 (Altschul et al., supra). The parameters for this search were E=0.05, V=50, B=50, where E, V, and B are defined as above.

12. The BAC sequence was compared to the STS division of Genbank database (National Center for Biotchnology Information, National Library of Medicine, 38A, 8N905, 8600 Rockville Pike, Bethesda, Md. 20894; www.ncbi.nlm.nih.gov) using blastn2 (Altschul et al., supra). The parameters for this search were E=0.05, V=50, B=50, where E, V, and B are defined as above.

13. The BAC sequence was compared to the Expressed Sequence (EST) Tag Genbank database (National Center for Biotchnology Information, National Library of Medicine, 38A, 8N905, 8600 Rockville Pike, Bethesda, Md. 20894; www.ncbi.nlm.nih.gov) using blastn2 (Altschul et al., supra). The parameters for this search were E=0.05, V=250, B=250, where E, V, and B are defined as above.

Gene Identification by Direct cDNA Selection

Primary Tinkered cDNA pools were prepared from bone marrow, calvarial bone, femoral bone, kidney, skeletal muscle, testis and total brain. Poly (A)+ RNA was prepared from calvarial and femoral bone tissue (Chomczynski et al., *Anal. Biochem.*, 162:156–159 (1987); D'Alessio et al., *Focus*, 9:1–4 (1987)) and the remainder of the mRNA was purchased from Clontech (Palo Alto, Calif., U.S.A.). In order to generate oligo(dT) and random primed cDNA pools from the same tissue, 2.5 μg mRNA was mixed with oligo(dT) primer in one reaction and 2.5 μg mRNA was mixed with random hexamers in another reaction, and both were converted to first and second strand cDNA according to manufacturers' recommendations for cDNA synthesis (Life Technologies, Bethesda, Md., U.S.A.). Paired phosphorylated cDNA linkers (see sequence below) were annealed together by mixing in a 1:1 ratio (10 μg each) incubated at 65° C. for five minutes and allowed to cool to room temperature.

Linkers were ligated to all oligo (dT) and random primed cDNA pools (see below) according to manufacturers' instructions (Life Technologies, Bethesda, Md., U.S.A.).

Oligo 1/2 was ligated to oligo (dT) and random primed cDNA pools prepared from bone marrow. Oligo 3/4 was ligated to oligo (dT) and random primed cDNA pools prepared from calvarial bone. Oligo 5/6 was ligated to oligo (dT) and random primed cDNA pools prepared from brain and skeletal muscle. Oligo 7/8 was ligated to oligo (dT) and random primed cDNA pools prepared from kidney. Oligo 11/12 was ligated to oligo (dT) and random primed cDNA pools prepared from femoral bone.

The cDNA pools were evaluated for length distribution by PCR amplification using 1 μl of a 1:1, 1:10, and 1:100 dilution of the ligation reaction, respectively. PCR reactions were performed in a Perkin Elmer 9600, each 25 μl volume reaction contained 1 μl of DNA, 10 mM Tris-HCl (pH 8.3), 50 mM KCl, 1.5 mM MgCl2, 0.001% gelatin, 200 mM each dNTPs, 10 μM primer and 1 unit Taq DNA polymerase (Perkin Elmer) and was amplified under the following conditions: 30 seconds at 94° C., 30 seconds at 60° C. and 2 minutes at 72° C. for 30 cycles. The length distribution of the amplified cDNA pools were evaluated by electrophoresis on a 1% agarose gel. The PCR reaction that gave the best representation of the random primed and oligo (dT) primed cDNA pools was scaled up so that ~2–3 μg of each cDNA pool was produced. The starting cDNA for the direct selection reaction comprised of 0.5 μg of random primed cDNAs mixed with 0.5 μg of oligo (dT) primed cDNAs.

The DNA from the 54 BACs that were used in the direct cDNA selection procedure was isolated using Nucleobond AX columns as described by the manufacturer (The Nest Group, Inc., Southborough, Mass. 01772, U.S.A.).

The BACs were pooled in equimolar amounts and 1 μg of the isolated genomic DNA was labelled with biotin 16-UTP by nick translation in accordance with the manufacturer's instructions (Boehringer Mannheim (Roche Molecular Biochemicals, Indianapolis, Ind. 46250-0414, U.S.A.)). The incorporation of the biotin was monitored by methods described in Del Mastro and Lovett, *Methods in Molecular Biology*, Humana Press Inc., NJ (1996).

Direct cDNA selection was performed using methods described in Del Mastro and Lovett, *Methods in Molecular Biology*, Humana Press Inc., NJ (1996). Briefly, the cDNA pools were multiplexed in two separate reactions in the first reaction, cDNA pools from bone marrow, calvarial bone,

```
Paired linkers oligo 1/2
OLIGO 1: 5'CTG AGC GGA ATT CGT GAG ACC3' (SEQ ID NO: 37)
OLIGO 2: 5'TTG GTC TCA CGT ATT CCG CTC GA3' (SEQ ID NO: 38)

Paired linkers oligo 3/4
OLIGO 3: 5'CTC GAG AAT TCT GGA TCC TC3' (SEQ ID NO: 39)
OLIGO 4: 5'TTG AGG ATC CAG AAT TCT CGA G3' (SEQ ID NO: 40)

Paired linkers oligo 5/6
OLIGO 5: 5'TGT ATG CGA ATT CGC TGC GCG3' (SEQ ID NO: 41)
OLIGO 6: 5'TTC GCG CAG CGA ATT CGC ATA CA3' (SEQ ID NO: 42)

Paired linkers oligo 7/8
OLIGO 7: 5'GTC CAC TGA ATT CTC AGT GAG3' (SEQ ID NO: 43)
OLIGO 8: 5'TTG TCA CTG AGA ATT CAG TGG AC3' (SEQ ID NO: 44)

Paired linkers oligo11/12
OLIGO 11: 5'GAA TCC GAA TTC CTG GTC AGC3' (SEQ ID NO: 45)
OLIGO 12: 5'TTG CTG ACC AGG AAT TCG GAT TC3' (SEQ ID NO: 46)
``` brain and testis were mixed, and in the second, cDNA pools from skeletal muscle, kidney and femoral bone were mixed. Suppression of the repeats, yeast sequences and plasmid in the cDNA pools was performed to a Cot of 20. 100 ng of biotinylated BAC DNA was mixed with the suppressed cDNAs and hybridized in solution to a Cot of 200. The biotinylated DNA and the cognate cDNAs was captured on streptavidin-coated paramagnetic beads. The beads were washed and the primary selected cDNAs were eluted. These cDNAs were PCR amplified and a second round of direct selection was performed. The product of the second round of direct selection is referred to as the secondary selected material. A Galanin cDNA clone, previously shown to map to 11q12–13 (Evans, *Genomics*, 18:473–477 (1993)), was used to monitor enrichment during the two rounds of selection.

The secondary selected material from bone marrow, calvarial bone, femoral bone, kidney, skeletal muscle, testis and total brain was PCR amplified using modified primers of oligos 1, 3, 5, 7 and 11, shown below, and cloned into the UDG vector pAMP10 (Life Technologies, Bethesda, Md., U.S.A.), in accordance with the manufacturer's recommendations.

Modified Primer Sequences:

```
Oligo1-CUA: 5'CUA CUA CUA CUA CTG AGC GGA ATT CGT GAG ACC3'
(SEQ ID NO: 47)

Oligo3-CUA: 5'CUA CUA CUA CUA CTC GAG AAT TCT GGA TCC TC3'
(SEQ ID NO: 48)

Oligo5-CUA: 5'CUA CUA CUA CUA TGT ATG CGA ATT CGC TGC GCG3'
(SEQ ID NO: 49)

Oligo7-CUA: 5'CUA CUA CUA CUA GTC CAC TGA ATT CTC AGT GAG3'
(SEQ ID NO: 50)

Oligo11-CUA: 5'CUA CUA CUA CUA GAA TCC GAA TTC CTG GTC AGC3'
(SEQ ID NO: 51)
```

The cloned secondary selected material, from each tissue source, was transformed into MAX Efficiency DH5a Competent Cells (Life Technologies, Bethesda, Md., U.S.A.) as recommended by the manufacturer. 384 colonies were picked from each transformed source and arrayed into four 96 well microtitre plates.

All secondarily selected cDNA clones were sequenced using M13 dye primer terminator cycle sequencing kit (Perkin Elmer Applied Biosystems, Foster City, Calif. 94404, U.S.A.), and the data collected by the ABI 377 automated fluorescence sequencer (Perkin Elmer Applied Biosystems, supra).

All sequences were analyzed using the BLASTN, BLASTX and FASTA programs (Altschul et al., *J. Mol. Biol.*, 215:403–410 (1990), Altschul et al., supra). The cDNA sequences were compared to a database containing sequences derived from human repeats, mitochondrial DNA, ribososomal RNA, *E. coli* DNA to remove background clones from the dataset using the program cross_match. A further round of comparison was also performed using the program BLASTN2 against known genes (Genbank) and the BAC sequences from the HBM region. Those cDNAs that were >90% homologous to these sequences were filed according to whether they hit a BAC or known gene from the HBM region and the data stored in a database for further analysis. cDNA sequences that were identified but did not have significant similarity to the BAC sequences from the HBM region or were eliminated by cross_match were hybridized to nylon membranes which contained the BACs from the HBM region, to ascertain whether they hybridized to the target.

Hybridization analysis was used to map the cDNA clones to the BAC target that selected them. The BACs that were identified from the HBM region were arrayed and grown into a 96 well microtitre plate. LB agar containing 25 μg/ml kanamycin was poured into 96 well microtitre plate lids. Once the agar had solidified, pre-cut Hybond N+ nylon membranes (Amersham Pharmacia Biotech, Inc., Piscataway, N.J. 08855-1327, U.S.A.) were laid on top of the agar and the BACs were stamped onto the membranes in duplicate using a hand held 96 well replica plater (V&P Scientific, Inc., San Diego, Calif. 92121, U.S.A.). The plates were incubated overnight at 37° C. The membranes were processed according to the manufacturer's recommendations.

The cDNAs that needed to be mapped by hybridization were PCR amplified using the relevant primer (oligos 1, 3, 5, 7 and 11) that would amplify that clone. For this PCR amplification, the primers were modified to contain a Tinkered digoxigenin molecule at the 5' of the oligonucleotide. The PCR amplification was performed under the same conditions as described in Preparation of cDNA Pools (above). The PCR products were evaluated for quality and quantity by electrophoresis on a 1% agarose gel by loading 5 μl of the PCR reaction. The nylon membranes containing the stamped BACs were individually pre-hybridized in 50 ml conical tubes containing 10 ml of hybridization solution (5× SSPE, 0.5× Blotto, 2.5% SDS and 1 mM EDTA (pH 8.0)). The 50 ml conical tubes were placed in a rotisserie oven for 2 hours at 65° C. 25 ng of each cDNA probe was denatured and added into individual 50 ml conical tubes containing the nylon membrane and hybridization solution. The hybridization was performed overnight at 65° C. The filters were washed for 20 minutes at 65° C. in each of the following solutions: 3× SSPE, 0.1% SDS; 1× SSPE, 0.1% SDS and 0.1× SSPE, 0.1% SDS.

The membranes were removed from the 50 ml conical tubes and placed in a dish. Acetate sheets were placed between each membrane to prevent them from sticking to each other. The incubation of the membranes with the Anti-DIG-AP and CDP-Star was performed according to manufacturer's recommendations (Boehringer Mannheim, supra). The membranes were wrapped in Saran wrap and exposed to Kodak Bio-Max X-ray film for 1 hour.

cDNA Cloning and Expression Analysis

To characterize the expression of the genes identified by direct cDNA selection and genomic DNA sequencing in comparison to the publicly available databases, a series of experiments were performed to further characterize the genes in the HBM region. First, oligonucleotide primers were designed for use in the polymerase chain reaction (PCR) so that portions of a cDNA, EST, or genomic DNA could be amplified from a pool of DNA molecules (a cDNA library) or RNA population (RT-PCR and RACE). The PCR primers were used in a reaction containing genomic DNA to verify that they generated a product of the size predicted based on the genomic (BAC) sequence. A number of cDNA libraries were then examined for the presence of the specific cDNA or EST. The presence of a fragment of a transcription unit in a particular cDNA library indicates a high probability that additional portions of the same transcription unit will be present as well.

A critical piece of data that is required when characterizing novel genes is the length, in nucleotides, of the processed transcript or messenger RNA (mRNA). One skilled in the art primarily determines the length of an mRNA by Northern blot hybridization (Sambrook et al., *Molecular Cloning: A Laboratory Manual*, Cold Spring Harbor Laboratory, Cold Spring Harbor N.Y. (1989)). Groups of ESTs and direct-selected cDNA clones that displayed significant sequence similarity to sequenced BACs in the critical region were grouped for convenience into approximately 30 kilobase units. Within each 30 kilobase unit there were from one up to fifty ESTs and direct-selected cDNA clones which comprised one or more independent transcription units. One or more ESTs or direct-selected cDNAs were used as hybridization probes to determine the length of the mRNA in a variety of tissues, using commercially available reagents (Multiple Tissue Northern blot; Clontech, Palo Alto, Calif., U.S.A.) under conditions recommended by the manufacturer.

Directionally cloned cDNA libraries from femoral bone, and calvarial bone tissue were constructed by methods familiar to one skilled in the art (for example, Soares in *Automated DNA Sequencing and Analysis*, Adams, Fields and Venter, Eds., Academic Press, NY, pages 110–114 (1994)). Bones were initially broken into fragments with a hammer, and the small pieces were frozen in liquid nitrogen and reduced to a powder in a tissue pulverizer. RNA was extracted from the powdered bone by homogenizing the powdered bone with a standard Acid Guanidinium Thiocyanate-Phenol-Chloroform extraction buffer (e.g. Chomczynski and Sacchi, *Anal. Biochem.*, 162:156–159 (1987)) using a polytron homogenizer (Brinkman Instruments Inc., Westbury, N.Y. 11590-0207, U.S.A.). Additionally, human brain and lung total RNA was purchased from Clonetech (supra). PolyA RNA was isolated from total RNA using dynabeads-dT according to the manufacturer's recommendations (Dynal, Inc., Lake Success, N.Y. 11042, U.S.A.).

First strand cDNA synthesis was initiated using an oligonucleotide primer with the sequence:

5'-AACTGGAAGAATTC GCGGCCGCAGGAATTTTTTTTTTTTTTTT-3' (SEQ ID NO: 52).

This primer introduces a NotI restriction site (underlined) at the 3' end of the cDNA. First and second strand synthesis were performed using the "one-tube" cDNA synthesis kit as described by the manufacturer (Life Technologies, Bethesda, Md., U.S.A.). Double stranded cDNAs were treated with T4 polynucleotide kinase to ensure that the ends of the molecules were blunt (Soares in *Automated DNA Sequencing and Analysis*, Adams, Fields and Venter, Eds., Academic Press, NY, pages 110–114 (1994)), and the blunt ended cDNAs were then size selected by a Biogel column (Huynh et al. in *DNA Cloning*, Vol. 1, Glover, Ed., IRL Press, Oxford, pages 49–78 (1985)) or with a size-sep 400 sepharose column (Amersham Pharmacia Biotech, Inc., Piscataway, N.J. 08855-1327, U.S.A. catalog no. 27–5105-01). Only cDNAs of 400 base pairs or longer were used in subsequent steps. EcoRI adapters (sequence: 5' OH-AAT-TCGGCACGAG-OH 3' (SEQ ID NO: 53), and 5' p-CTCGTGCCG-OH 3' (SEQ ID NO: 54)) were then ligated to the double stranded cDNAs by methods familiar to one skilled in the art (Soares, 1994). The EcoRI adapters were then removed from the 3' end of the cDNA by digestion with NotI (Soares, 1994). The cDNA was then ligated into the plasmid vector pBluescript II KS+ (Stratagene, La Jolla, Calif., U.S.A.), and the ligated material was transformed into *E. coli* host DH10B or DH12S by electroporation methods familiar to one skilled in the art (Soares, 1994). After growth overnight at 37° C., DNA was recovered from the *E. coli* colonies after scraping the plates by processing as directed for the Mega-prep kit (Qiagen, Chatsworth, Calif., U.S.A.). The quality of the cDNA libraries was estimated by counting a portion of the total numbers of primary transformants and determining the average insert size and the percentage of plasmids with no cDNA insert. Additional cDNA libraries (human total brain, heart, kidney, leukocyte, and fetal brain) were purchased from Life Technologies, supra.

cDNA libraries, both oligo (dT) and random hexamer ($N_6$) primed, were used for isolating cDNA clones transcribed within the HBM region: human bone, human brain, human kidney and human skeletal muscle (all cDNA libraries were made by the inventors, except for skeletal muscle (dT) and kidney (dT) cDNA libraries). Four 10×10 arrays of each of the cDNA libraries were prepared as follows: the cDNA libraries were titered to $2.5 \times 10^6$ using primary transformants. The appropriate volume of frozen stock was used to inoculate 2 L of LB/ampicillin (100 mg/ml). This inoculated liquid culture was aliquotted into 400 tubes of 4 ml each. Each tube contained approximately 5000 cfu. The tubes were incubated at 30° C. overnight with gentle agitation. The cultures were grown to an OD of 0.7–0.9. Frozen stocks were prepared for each of the cultures by aliquotting 100 µl of culture and 300 µl of 80% glycerol. Stocks were frozen in a dry ice/ethanol bath and stored at −70° C. The remaining culture was DNA prepared using the Qiagen (Chatsworth, Calif., U.S.A.) spin miniprep kit according to the manufacturer's instructions. The DNAs from the 400 cultures were pooled to make 80 column and row pools. The cDNA libraries were determined to contain HBM cDNA clones of interest by PCR. Markers were designed to amplify putative exons. Once a standard PCR optimization was performed and specific cDNA libraries were determined to contain cDNA clones of interest, the markers were used to screen the arrayed library. Positive addresses indicating the presence of cDNA clones were confirmed by a second PCR using the same markers.

Once a cDNA library was identified as likely to contain cDNA clones corresponding to a specific transcript of interest from the HBM region, it was manipulated to isolate the clone or clones containing cDNA inserts identical to the EST or direct-selected cDNA of interest. This was accomplished by a modification of the standard "colony screening" method (Sambrook et al, Molecular Cloning: A Laboratory Manual, Cold Spring Harbor Laboratory, Cold Spring Harbor N.Y. (1989)). Specifically, twenty 150 mm LB+ampicillin agar plates were spread with 20,000 colony forming units (cfu) of cDNA library and the colonies allowed to grow overnight at 37° C. Colonies were transferred to nylon filters (Hybond from Amersham, supra, or equivalent) and duplicates prepared by pressing two filters together essentially as described (Sambrook et al, *Molecular Cloning: A Laboratory Manual*, Cold Spring Harbor Laboratory, Cold Spring Harbor N.Y. (1989)). The "master" plate was then incubated an additional 6–8 hours to allow the colonies to grow back. The DNA from the bacterial colonies was then affixed to the nylon filters by treating the filters sequentially with denaturing solution (0.5 N NaOH, 1.5 M NaCl) for two minutes, neutralization solution (0.5 M Tris-Cl pH 8.0, 1.5 M NaCl) for two minutes (twice). The bacterial colonies were removed from the filters by washing in a solution of 2×SSC/ 0.1% SDS for one minute while rubbing with tissue paper. The filters were air dried and baked under vacuum at 80° C. for 1–2 hours.

A cDNA hybridization probe was prepared by random hexamer labelling (Fineberg and Vogelstein, *Anal. Biochem.*, 132:6–13 (1983)) or by including gene-specific primers and no random hexamers in the reaction (for small fragments). Specific activity was calculated and was >5×10$^8$ cpm/10$^8$ µg of cDNA. The colony membranes were then prewashed in 10 mM Tris-Cl pH 8.0, 1 M NaCl, 1 mM EDTA, 0.1% SDS for 30 minutes at 55° C. Following the prewash, the filters were prehybridized in >2 ml/filter of 6×SSC, 50% deionized formamide, 2% SDS, 5× Denhardt's solution, and 100 mg/ml denatured salmon sperm DNA, at 42° C. for 30 minutes. The filters were then transferred to hybridization solution (6×SSC, 2% SDS, 5× Denhardt's, 100 mg/ml denatured salmon sperm DNA) containing denatured $^{32}$P-dCTP-labelled cDNA probe and incubated at 42° C. for 16–18 hours.

After the 16–18 hour incubation, the filters were washed under constant agitation in 2×SSC, 2% SDS at room temperature for 20 minutes, followed by two washes at 65° C. for 15 minutes each. A second wash was performed in 0.5×SSC, 0.5% SDS for 15 minutes at 65° C. Filters were then wrapped in plastic wrap and exposed to radiographic film for several hours to overnight. After film development, individual colonies on plates were aligned with the autoradiograph so that they could be picked into a 1 ml solution of LB Broth containing ampicillin. After shaking at 37° C. for 1–2 hours, aliquots of the solution were plated on 150 mm plates for secondary screening. Secondary screening was identical to primary screening (above) except that it was performed on plates containing ~250 colonies so that individual colonies could be clearly identified for picking.

After colony screening with radiolabelled probes yielded cDNA clones, the clones were characterized by restriction endonuclease cleavage, PCR, and direct sequencing to confirm the sequence identity between the original probe and the isolated clone. To obtain the full-length cDNA, the novel sequence from the end of the clone identified was used to probe the library again. This process was repeated until the length of the cDNA cloned matches that estimated to be full-length by the northern blot analysis. RT-PCR was used as another method to isolate full length clones. The cDNA was synthesized and amplified using a "Superscript One Step RT-PCR" kit (Life Technologies, Gaithersburg, Md., U.S.A.). The procedure involved adding 1.5 µg of RNA to the following: 25 µl of reaction mix provided which is a proprietary buffer mix with MgSO$_4$ and dNTP's, 1 µl sense primer (10 µM) and 1 µl anti-sense primer (10 µM), 1 µl reverse transcriptase and Taq DNA polymerase mix provided and autoclaved water to a total reaction mix of 50 µl. The reaction was then placed in a thermocycler for 1 cycle at 50 C for 15 to 30 minutes, then 94° C. for 15 seconds, 55–60° C. for 30 seconds and 68–72° C. for 1 minute per kilobase of anticipated product and finally 1 cycle of 72° C. for 5–10 minutes. The sample was analyzed on an agarose gel. The product was excised from the gel and purified from the gel (GeneClean, Bio 101, Inc., supra). The purified product was cloned in pCTNR (General Contractor DNA Cloning System, 5 Prime -3 Prime, Inc., Boulder, Colo., U.S.A.) and sequenced to verify that the clone was specific to the gene of interest.

Rapid Amplification of cDNA ends (RACE) was performed following the manufacturer's instructions using a Marathon cDNA Amplification Kit (Clonetech, Palo Alto, Calif., U.S.A.) as a method for cloning the 5' and 3' ends of candidate genes. cDNA pools were prepared from total RNA by performing first strand synthesis, where a sample of total RNA sample was mixed with a modified oligo (dT) primer, heated to 70° C., cooled on ice and followed by the addition of: 5× first strand buffer, 10 mM dNTP mix, and AMV Reverse Transcriptase (20 U/µl). The tube was incubated at 42° C. for one hour and then the reaction tube was placed on ice. For second strand synthesis, the following components were added directly to the reaction tube: 5× second strand buffer, 10 mM dNTP mix, sterile water, 20× second strand enzyme cocktail and the reaction tube was incubated at 16° C. for 1.5 hours. T4 DNA Polymerase was added to the reaction tube and incubated at 16° C. for 45 minutes. The second-strand synthesis was terminated with the addition of an EDTA/Glycogen mix. The sample was subjected to a phenol/chloroform extraction and an ammonium acetate precipitation. The cDNA pools were checked for quality by analyzing on an agarose gel for size distribution. Marathon cDNA adapters (Clonetech, supra) were then ligated onto the cDNA ends. The specific adapters contained priming sites that allowed for amplification of either 5' or 3' ends, depending on the orientation of the gene specific primer (GSP) that was chosen. An aliquot of the double stranded cDNA was added to the following reagents: 10 µM Marathon cDNA adapter, 5× DNA ligation buffer, T4 DNA ligase. The reaction was incubated at 16° C. overnight. The reaction was heat inactivated to terminate the reaction. PCR was performed by the addition of the following to the diluted double stranded cDNA pool: 10× cDNA PCR reaction buffer, 10 µM dNTP mix, 10 µM GSP, 10 µM AP1 primer (kit), 50× Advantage cDNA Polymerase Mix. Thermal Cycling conditions were 94° C. for 30 seconds, 5 cycles of 94° C. for 5 seconds, 72° C. for 4 minutes, 5 cycles of 94° C. for 5 seconds, 70° C. for 4 minutes, 23 cycles of 94° C. for 5 seconds, 68° C. for 4 minutes. After the first round of PCR was performed using the GSP to extend to the end of the adapter to create the adapter primer binding site, exponential amplification of the specific cDNA of interest was observed. Usually a second nested PCR is performed to confirm the specific cDNA. The RACE product was analyzed on an agarose gel and then excised and purified from the gel (GeneClean, BIO 101, Inc., supra). The RACE product was then cloned into pCTNR (General Contractor DNA Cloning System, 5'-3', Inc., supra) and the DNA sequence determined to verify that the clone is specific to the gene of interest.

Mutation Analysis

Comparative genes were identified using the above procedures and the exons from each gene were subjected to mutation detection analysis. Comparative DNA sequencing was used to identify polymorphisms in HBM region genes from chromosome 11q12–13. DNA sequences for candidate genes were amplified from patient lymphoblastoid cell lines.

Polymerase chain reaction (PCR) was used to generate sequencing templates from the HBM family's DNA and monochromsomal controls. Enzymatic amplification of genes within the HBM region on 11q12–13 was accomplished using the PCR with oligonucleotides flanking each exon as well as the putative 5' regulatory elements of each gene. The primers were chosen to amplify each exon as well as 15 or more base pairs within each intron on either side of the splice. All PCR primers were made as chimeras to facilitate dye primer sequencing. The M13-21F (5'-GTA A CGA COG CCA GT-3' (SEQ ID NO: 55)) and -28REV (5'-AAC AGC TAT GAC CAT G-3' (SEQ ID NO: 56)) primer binding sites were built on to the 5' end of each forward and reverse PCR primer, respectively, during synthesis. 150 ng of genomic DNA was used in a 50 µl PCR with 2UAmpliTaq, 500 nM primer and 125 µM dNTP. Buffer and cycling conditions were specific to each primer set. TaqStart antibody (Clontech, supra) was used for hot start PCR to minimize primer dimer formation. 10% of the product was examined on an agarose gel. The appropriate samples were diluted 1:25 with deionized water before sequencing.

Each PCR product was sequenced according to the standard Energy Transfer primer (Amersham, supra) protocol. All reactions took place in 96 well trays. 4 separate reactions, one each for A, C, G and T were performed for each template. Each reaction included 2 µl of the sequencing reaction mix and 3 µl of diluted template. The plates were then heat sealed with foil tape and placed in a thermal cycler and cycled according to the manufacturer's recommendation. After cycling, the 4 reactions were pooled. 3 µl of the pooled product was transferred to a new 96 well plate and 1 µl of the manufacturer's loading dye was added to each well. All 96 well pipetting procedures occurred on a Hydra 96 pipetting station (Robbins Scientific, Sunnyvale, Calif. 94086-1411, U.S.A.). 1 µl of pooled material was directly loaded onto a 48 lane gel running on an ABI 377 DNA sequencer for a 10 hour, 2.4 kV run.

Polyphred (University of Washington, Seattle, Wash. 98195-2350, U.S.A.) was used to assemble sequence sets for viewing with Consed (University of Washington, supra). Sequences were assembled in groups representing all relevant family members and controls for a specified target region. This was done separately for each of the three stages. Forward and reverse reads were included for each individual along with reads from the monochromosomal templates and a color annotated reference sequence. Polyphred indicated potential polymorphic sites with a purple flag. Two readers independently viewed each assembly and assessed the validity of the purple-flagged sites.

Single nucleotide polymorphisms (SNP's) which were discovered in Zmax7A, Zmax7B, Zmax20, Zmax61A, Zmax61B, and Zmax113 are provided in Table 2. Column one lists the gene which contains the SNP. Column two contains the corresponding BAC location. Column three provides a reference sequence in which the SNP appears underlined, and column four provides the location of the SNP. Column five lists the base change or deletion of the SNP. Column six lists whether the SNP is located in an exon or intron. Column seven provides the SEQ ID NO of the sequence that contains the contig in which the SNP was discovered.

TABLE 2

| Zmax | BAC Location | Reference Sequence | Coordinate | Polymorphism | Intron/Exon | SEQ ID NO |
|---|---|---|---|---|---|---|
| 7A & 7B | b576i10-h_980727_Contig197G | TGATTATTTAGGTAGAGACAA | 71734 | G > A | Intron | 17 |
| 7A & 7B | B200e21-h_971124_Contig3 | CAAAAATATTCAGAGAAAGCT | 16995 | C > T | Intron | 19 |
| 7A & 7B | B200e21-h_971124_Contig3 | TCTAAACTGGCCCCCCTGGGT | 37717 | C > G | Intron | 19 |
| 7A & 7B | B200e21-h_971124_Contig3 | CTTCATACACTTCCTGTAGGA | 56094 | T > C | Intron | 19 |
| 7A & 7B | b576i10-h_980727_Contig197G | AACTACCAAATGAAACAAAAA | 30642 | T > C | Intron | 17 |
| 7A & 7B | b576i10-h_980727_Contig197G | CGCCTGACTCGGCCTCCAGAA | 46845 | G > A | Intron | 17 |
| 7A & 7B | b576i10-h_980727_Contig197G | AAAAACAAAATAAAAGTGTAGGAAG | 53947 | 5 bp deletion TAAAA | Intron | 17 |
| 7A & 7B | b576i10-h_980727_Contig197G | AAAAGATCTTCCATTTACCTC | 68452 | C > T | Intron | 17 |
| 7A & 7B | b576i10-h_980727_Contig197G | TGGAGAAAGCTTTTTTAAATA | 63364 | T > A | Intron | 17 |
| 7A & 7B | b576i10-h_980727_Contig197G | GTCAGCGGCCTAAGACTTGAG | 34455 | T > G | Intron | 17 |
| 7A & 7B | b576i10-h_980727_Contig197G | GCTCTTTTTGAGTTAAAATGA | 54690 | A > G | Intron | 17 |
| 7A & 7B | b200e21-h_971124_Contig2 | GGTGGGGGGGTGGGTGGTCC | 5323 | G > deletion | Intron | 18 |
| 7A & 7B | b200e21-h_971124_Contig2 | AGTCCCGAGGTTGAGTGAGGC | 15181 | T > C | Intron | 18 |
| 7A & 7B | b200e21-h_971124_Contig2 | ATATCTCGGGGTTTTTTTTTT | 16445 | G > T | Intron | 18 |
| 7A & 7B | b200e21-h_971124_Contig3 | CCCACAGTCGCAGGCAGGGCT | 43036 | C > G | Intron | 19 |
| 7A & 7B | b200e21-h_971124_Contig3 | GGTCAGTGGATATAAATCTTA | 43345 | T > C | Intron | 19 |
| 7A & 7B | b200e21-h_971124_Contig3 | TCAAGCAATCGACCACCTCTG | 44928 | G > A | Intron | 19 |
| 7A & 7B | b200e21-h_971124_Contig3 | GTAAAAAGTGTAAATTATCTA | 54199 | T > C | Intron | 19 |
| 7A & 7B | b200e21-h_971124_Contig3 | CCCGGTGCCCTGGAAGCAGTG | 58443 | T > A | Intron | 19 |
| 7A & 7B | b200e21-h_971124_Contig3 | TCTGCATGCTACTACTTCAGC | 58484 | A > C | Intron | 19 |
| 7A & 7B | b200e21-h_971124_Contig3 | ATCACGCCACTGCACTCCAGC | 64303 | T > C | Intron | 19 |
| 7A & 7B | b200e21-h_971124_Contig3 | GTAATTGTATGCAATCAGCTT | 64396 | G > A | Intron | 19 |
| 7A & 7B | b576i10-h_980727_Contig197G | TGAACATAAATACAACCAAAA | 70152 | T > C | Intron | 17 |
| 7A & 7B | b576i10-h_980727_Contig197G | ACCCAACAAAAATGTAATTCA | 70323 | A > C | Intron | 17 |
| 7A & 7B | b200e21-h_971124_Contig3 | ATCATTCAAGCTTATCGACCA | 14149 | C > G | Intron | 19 |
| 7A & 7B | b200e21-h_971124_Contig3 | TCAAAGGTACGCTATTACAGC | 19630 | G > A | Intron | 19 |
| 7A & 7B | b200e21-h_971124_Contig3 | AAGATTGAGAAGAGCAATATT | 27679 | A > G | Intron | 19 |
| 7A & 7B | b200e21-h_971124_Contig3 | AAAACATCCTACATACCTAGG | 29974 | A > T, A > deletion | Intron | 19 |
| 7A & 7B | b200e21-h_971124_Contig3 | GACTGCTGGGCCCATCTCTCA | 32686 | C > T | Intron | 19 |
| 7A & 7B | b200e21-h_971124_Contig3 | ACAAATAGTACGTGAGTGCTT | 33201 | C > T | Intron | 19 |
| 7A & 7B | b200e21-h_971124_Contig3 | GCCCAGCTTTTAAAATCTCTC | 38123 | T > G | Intron | 19 |
| 7A & 7B | b200e21-h_971124_Contig3 | CAACCCTCCCTCCTTCCATTT | 38356 | T > C | Intron | 19 |
| 7A & 7B | b200e21-h_971124_Contig3 | TAAATGACTGTAGTCAACCAT | 38742 | T > C | Intron | 19 |
| 7A & 7B | b200e21-h_971124_Contig3 | GCGCTCCACCGAGCCTGTCAT | 40388 | G > A | Intron | 19 |

TABLE 2-continued

| Zmax | BAC Location | Reference Sequence | Coordinate | Polymorphism | Intron/Exon | SEQ ID NO |
|---|---|---|---|---|---|---|
| 20 | b180d17-h_971113_Contig11 | GTGGGTGCGGGGTAGGGTGGG | 15412 | G > A | Intron | 20 |
| 20 | b180d17-h_971113_Contig11 | TGGTCTGCCCGCCTTGGCCTC | 15849 | G > A | Intron | 20 |
| 20 | b180d17-h_971113_Contig11 | GGGGCCTGATAGGACTTAGTG | 16607 | A > T | Intron | 20 |
| 20 | b180d17-h_971113_Contig11 | TTTTCTTTTTTTTTTTTTTTT | 17452 | T > C | Intron | 20 |
| 20 | b180d17-h_971113_Contig11 | CTGGGATTAGAGGCATGCGCC | 17590 | A > G | Intron | 20 |
| 20 | b180d17-h_971113_Contig11 | CCGGCGGCGGCGATGGCCTCG | 14743 | C > T | Intron | 20 |
| 20 | b180d17-h_971113_Contig11 | TGCTGGAGCTCGAGAGAGACG | 14801 | C > T | Intron | 20 |
| 20 | b180d17-h_971113_Contig11 | ACATGCTGCTCCAGTTAAACT | 2033 | C > A | Intron | 20 |
| 20 | b180d17-h_971113_Contig11 | GTGGACCTGACAGCCAGCACC | 7558 | C > T | Intron | 20 |
| 61A & 61B | B160d8-h_980304_Contig5 | GTCCTTTCTCGGCAGGCTGAC | 43936 | G > A | Intron | 26 |
| 61A & 61B | b47303-h_980515_Contig090D | CCGTCCAGGCAGATTAAGTCG | 20925 | A > G | Exon | 27 |
| 61A & 61B | b47303-h_980515_Contig090D | AACCACTCAAGTGACTCAGAA | 21037 | C > G | Exon | 27 |
| 61A & 61B | B160d8-h_980304_Contig4 | AGTAAAAAGAAACTCATGACC | 13225 | C > T | Exon | 23 |
| 61A & 61B | b47303-h_980515_Contig090D | GCAAGACTTATTGATGAAAAT | 21881 | T > C | Exon | 27 |
| 61A & 61B | b47303-h_980515_Contig090D | TCTTCCATGACGGGCACCTGT | 22352 | C > T | Exon | 27 |
| 61A & 61B | b47303-h_980515_Contig090D | GTGAGTGTCATAGGGACACAG | 22602 | T > C | Intron | 27 |
| 61A & 61B | b47303-h_980515_Contig090D | GATGAGCCTCAGGATGGATGT | 22638 | A > C | Intron | 27 |
| 61A & 61B | B160d8-h_980304_Contig5 | AGGTCACACAGCCAGTAAGTG | 17636 | G > C | Intron | 20 |
| 61A & 61B | B160d8-h_980304_Contig5 | GGTTGTGGTGGGGGCTGCTGC | 19203 | G > A | Intron | 20 |
| 61A & 61B | B160d8-h_980304_Contig5 | CCTAGAGGTTGAGGGACTTGC | 19522 | G > A | Intron | 20 |
| 61A & 61B | B160d8-h_980304_Contig5 | CCGGATGCAGTATCTCAGCCC | 19683 | T > C | Intron | 20 |
| 61A & 61B | B160d8-h_980304_Contig5 | GTTGAGTTTTTCTTCCCTGTT | 21015 | T > C | Intron | 20 |
| 61A & 61B | B160d8-h_980304_Contig5 | GCTTCTGTGCCGCCTGACTTT | 21202 | C > T | Intron | 20 |
| 61A & 61B | B160d8-h_980304_Contig5 | TGGAAAGCTGACCATCCACCT | 27480 | A > G | Intron | 20 |
| 61A & 61B | B160d8-h_980304_Contig5 | TGCCAGGGCACGACCAGGCCT | 31751 | C > G | Intron | 20 |
| 61A & 61B | B160d8-h_980304_Contig5 | GTCACCGAGCCCTGCAGGCAG | 31878 | C > G | Intron | 20 |
| 61A & 61B | B160d8-h_980304_Contig4 | TCAAATCCCAGAATAAGAGGG | 2427 | G > A | Intron | 23 |
| 61A & 61B | B160d8-h_980304_Contig4 | GACTGTGCCCGTCACCCTGGG | 5633 | G > A | Intron | 23 |
| 61A & 61B | B160d8-h_980304_Contig4 | ACATGCGTGCGTTTGGCGGGA | 7964 | G > T | Exon | 23 |
| 61A & 61B | B160d8-h_980304_Contig4 | TGGGTTCGGACGGCAGCAGGT | 8103 | C > T | Intron | 23 |
| 61A & 61B | B160d8-h_980304_Contig4 | ACATCCATCCGGAGGCTCATC | 11731 | G > T | Intron | 23 |
| 61A & 61B | B160d8-h_980304_Contig4 | CTGTGTCCCTGTGACACTCAC | 11767 | G > A | Intron | 23 |
| 61A & 61B | B160d8-h_980304_Contig4 | GAGGAGCCCGGGGAGGATGAG | 11897 | G > A | Exon | 23 |
| 61A & 61B | B160d8-h_980304_Contig4 | ACAGGTGCCCATCATGGAAGA | 12017 | A > G | Exon | 23 |
| 61A & 61B | B160d8-h_980304_Contig4 | CCCAACAACCATCTACAGAAC | 12129 | A > G | Exon | 23 |
| 61A & 61B | B160d8-h_980304_Contig4 | ATTTTCATCAGTAAGTCTTGC | 12488 | G > A | Exon | 23 |
| 61A & 61B | B160d8-h_980304_Contig5 | CCGCGGCCAGGTGGGACCTCT | 22100 | C > T | Exon | 26 |
| 61A & 61B | B160d8-h_980304_Contig5 | TGCACGGGGCATGGGAGGGTC | 22448 | A > G | Intron | 26 |
| 61A & 61B | B160d8-h_980304_Contig5 | CTCCACTTTGGGCTCAGTGAC | 30811 | G > A | Intron | 26 |
| 61A & 61B | B160d8-h_980304_Contig5 | TGGGGTCTCTGTGGTTCCAGC | 31213 | G > T | Intron | 26 |
| 61A & 61B | B160d8-h_980304_Contig5 | GCCCCAGCTCGAAGGCTGCTG | 31292 | G > A | Intron | 26 |
| 61A & 61B | B160d8-h_980304_Contig5 | CTGGCCATGAACTCAGCCTGC | 35414 | A > G | Intron | 26 |
| 61A & 61B | B160d8-h_980304_Contig5 | AGGCCTTTTTTTCGATAAGTG | 35765 | T > A | Intron | 26 |
| 61A & 61B | B160d8-h_980304_Contig5 | ACCGATACACTCTGCTGCCTC | 38845 | T > C | Intron | 26 |
| 61A & 61B | B160d8-h_980304_Contig5 | CCCGTCAGACTCCTTCCTGTG | 40004 | T > C | Intron | 26 |
| 61A & 61B | B160d8-h_980304_Contig5 | GGGAAGGGTCGGGGGTTCTGA | 40151 | G > A | Intron | 26 |
| 61A & 61B | B160d8-h_980304_Contig5 | CGTGCCCCCCGGGGACCCTGG | 40518 | G > C | Intron | 26 |
| 61A & 61B | B160d8-h_980304_Contig5 | GCAGGATGCTTGTTACAGGGG | 40766 | T > C | Intron | 26 |
| 61A & 61B | B160d8-h_980304_Contig5 | CAAGCCAGACGCCAGGGCAGG | 40831 | G > A | Intron | 26 |
| 61A & 61B | B160d8-h_980304_Contig5 | AGCTCCCACAGACAGGCCATG | 40977 | G > A | Exon | 26 |
| 61A & 61B | B160d8-h_980304_Contig4 | GTGGCTGGGATGGGACTCGG | 10002 | T > C | Intron | 23 |
| 61A & 61B | B160d8-h_980304_Contig5 | GTGTTCTGCTCTCAGCTGAGG | 41229 | C > G | Exon | 26 |
| 61A & 61B | B160d8-h_980304_Contig5 | GGGAATGGAGTTCTCTTTGGC | 41434 | T > A | Intron | 26 |
| 61A & 61B | B160d8-h_980304_Contig5 | TGGTCTTCATCGAAGATGCTA | 22136 | C > T | Exon | 26 |
| 61A & 61B | B160d8-h_980304_Contig5 | CGACTGACTGCGTCCAAGGCC | 22234 | C > G | Intron | 26 |
| 61A & 61B | B160d8-h_980304_Contig5 | TGCACGGGGCATGGGAGGGTC | 22448 | A > G | Intron | 26 |
| 61A & 61B | B160d8-h_980304_Contig5 | CAGGGATCCCCTGCGCCACAG | 16925 | C > T | Intron | 26 |
| 113 | b442p6-h_980814_Contig297G | ACTTCAGGAGTGCAGCTGAT | 1627 | T > G | Exon | 21 |
| 113 | b442p6-h_980814_Contig297G | TCCCACGACTGCAGCCTCCAG | 1785 | G > A | Exon | 21 |

Gene Potential Functions and Important Motifs

Chromosomal region 11q13 has been identified as an area of the human genome that has been genetical linked to a variety of diseases including: insulin dependent diabetes mellitus 4, (IDDM4) (Nakagawa et al., Am. J. Hum. Genet. 63:547–556 (1998)), osteopetrosis (Heaney et al., Hum. Mol. Genet. 7(9) 1407–10(1998)), osteoarthritis (Chapman et al., Am. J. Genet 65:000—000, 1999), asthma (Laing et al., J. Med. Genet. 35(6) 463–7 (1998)), Best's vitelliform macular dystrophy (Cooper et al., Genomics, 49(3):419–29 (1998)), multiple myeloma (Fonseca et al., Br. J Haematol. 101(2) 296–301 (1998)), multiple endocrine neoplasia (Chakrabarti et al., Genes Chromosomes Cancer 22(2): 130–7 (1998)), Plasma cell leukemia, (PCL) (Shimazaki et al., Int. J. Hematol. 66(1):111–5 (1997)), breast cancer (Hui et al., Oncogene 15(13):1617–23 (1997)), head and neck squamous cell carcinoma (Wang et al., Anticancer Res. (2A):925–31 (1999)), mantle cell lymphoma (Pott et al., Leukemia 12(10): 1630–7 (1998)), atopic dermatitis (Folster-Holst et al., Hum Genet 102(2):236–9 (1998)), and Meckel Syndrome characterized by occipital meningoencephalocele affecting the kidney and liver (Roume et al., Am. J. Genet 63:1095–1101, 1998).

The genes of chromosomal region 11q13 disclosed in this invention can have an important role in understanding the above identified diseases. The functions of Zmax7A, Zmax7B, Zmax8A, Zmax8B, Zmax20, Zmax61A, Zmax61B, and Zmax113 have been summarized from analyses of computer BLAST algorithms and a Motif program (GCG, Madison, Wis. 53711 U.S.A.).

Zmax113

The Zmax113 polypeptide has an Aldo/keto reductase family signature as detected using the Motifs program from the GCG sofware package (version 9.1; September 1997). The region of similarity is in the catalytic site, and the lysine that is absolutely required for activity in other Aldo/keto reductases is also present in zmax113. There is also an N-myristylation site, a Casein-kinase II consensus phosphorylation site, and multiple protein kinase C consensus phosphorylation sites. There is a stretch of approximately 20 amino acids that are likely to serve as a transmembrane anchor at approximately amino acids 400–420 (FIGS. 22A–22B). The N-terminal portion of the protein has a hydrophobic stretch of amino acids and thus the majority of the protein is likely to be located on the extracellular portion of the cell membrane. The cytoplasmic tail of Zmax113 protein contains one Casein kinase II and one protein kinase C consensus phosphorylation site. These sites are likely to be phosphorylated by their cognate kinases in response to aggregation of zmax113 protein in the cell membrane or by binding to the Zmax113 protein ligand. The most compelling similarity is to the mucin family of proteins, which are important cell-surface proteins and component of mucus, an essential biological product. Augmentation, elimination, or reduction of the activity of the Zmax113 polypeptide will demonstrate its importance in this capacity. The third pattern, located in the C-terminal region, is centered on a lysine residue whose chemical modification, in aldose and aldehyde reductases, affect the catalytic efficiency.

Zmax20

Zmax20, encoding a 206 amino acid open reading frame, is most similar to a predicted *C. elegans* protein of 551 amino acids. The Zmax20 ORF has similarity with a group of proteins bearing similarity to the large ribosomal subunit protein 21 (L21). This similarity is extends for up to 75% of the peptide's length, with lower similarity at the N-terminus. The sequence similarity is conserved in several evolutionary kingdoms, with eubacterial, plant, nemotode, and insect species represented. This conservation points to structural features of the protein that are likely to be involved in RNA binding. L21 has been demonstrated to be transcriptionally regulated in a manner consistent with its importance in cell proliferation, (Lin CH, et al. Cell Mol Biol Res 1994; 40(1):13–26). It is likely that Zmax20 is likewise important. Given the broad tissue distribution of the mRNA encoding Zmax20 protein, development of agents that modulate the activity of Zmax20 protein are likely to be active antiproliferative agents and therapeutically valuable for treating such diseases as cancer.

Zmax7

Zmax7 has two alternatively spiced mRNAs that are derived from a single primary transcript. These two forms, 4.9 kb and 5.4 kb in length, are hereafter termed the short (Zmax7A) and long forms (Zmax7B), respectively. The short form is comprised of 783 amino acids while the long form has 818 amino acids. The alternative splicing is likely to result in two protein products with distinct functions, and those functions can be inferred based on the primary sequence similarity between the Zmax7 proteins and those which have been described by others. The most significant similarities are to a human protein of unknown function, KIAA0685, which has 60% amino acid identity in the first 408 amino acids of the both the long and short forms. There is a reduced level of amino acid identity closer to the C-terminus of the protein. There is also significant similarity to SAP185 and SAP190, members of a class of yeast proteins termed the SIT4-associated proteins from the yeast, *Saccharomyces cerevisiae*. These proteins, which form a complex with SIT4, have been shown to be important for cell-cycle progression. In human cells, the Zmax7 proteins are likely to share this function. It is anticipated that overexpression or inhibition of Zmax7 gene expression will result in alterations in the cell's ability to proliferate. As such, agents that interfere or augment the Zmax7 protein's function or the Zmax7 gene's transcription are likely to have therapeutic value in treating diseases which involve altered cellular proliferation, such as cancer, HIV infection, apoptosis and other cell proliferation diseases.

Zmax8

Zmax8 is an alternatively spliced gene with mRNA species of 1.5, 3.5 (Zmax8A), 4, and 6 kb (Zmax8B). These alternative splicing events are due to different polyadenylation signals being recognized. The protein that is produced by all versions is identical.

The long forms of the mRNA both encode a protein of 885 amino acids in length with a predicted Mr of 99,187 and a pI of 9.0. The protein is very similar to several other proteins in the publicly available databases and therefore its function is likely to be important in the cell due to its evolutionary conservation. Proteins with similar amino acid sequence are found in plants (*Arabidopsis thaliana*), yeast (*Saccharomyces cerevisiae*), insects (*Drosophila melanogaster*), and nemotodes (*Caenorhabditis elegans*). Zmax8 protein has a SET domain located at its N-terminus between amino acids. The SET domain has been implicated in facilitating protein—protein interactions, particularly in proteins involved in cellular proliferation. For example, MMSET (Multiple Myeloma SET domain; M Chesi et al. Blood 1998 Nov. 1; 92(9):3025–34), a protein implicated in neoplastic transformation in multiple myelomas due to a t(4;14) translocation. It is likely that Zmax8 encodes a protein that, when its function is altered by inhibition or augmentation, will results in a change in cellular function.

Zmax61

Figure 23:
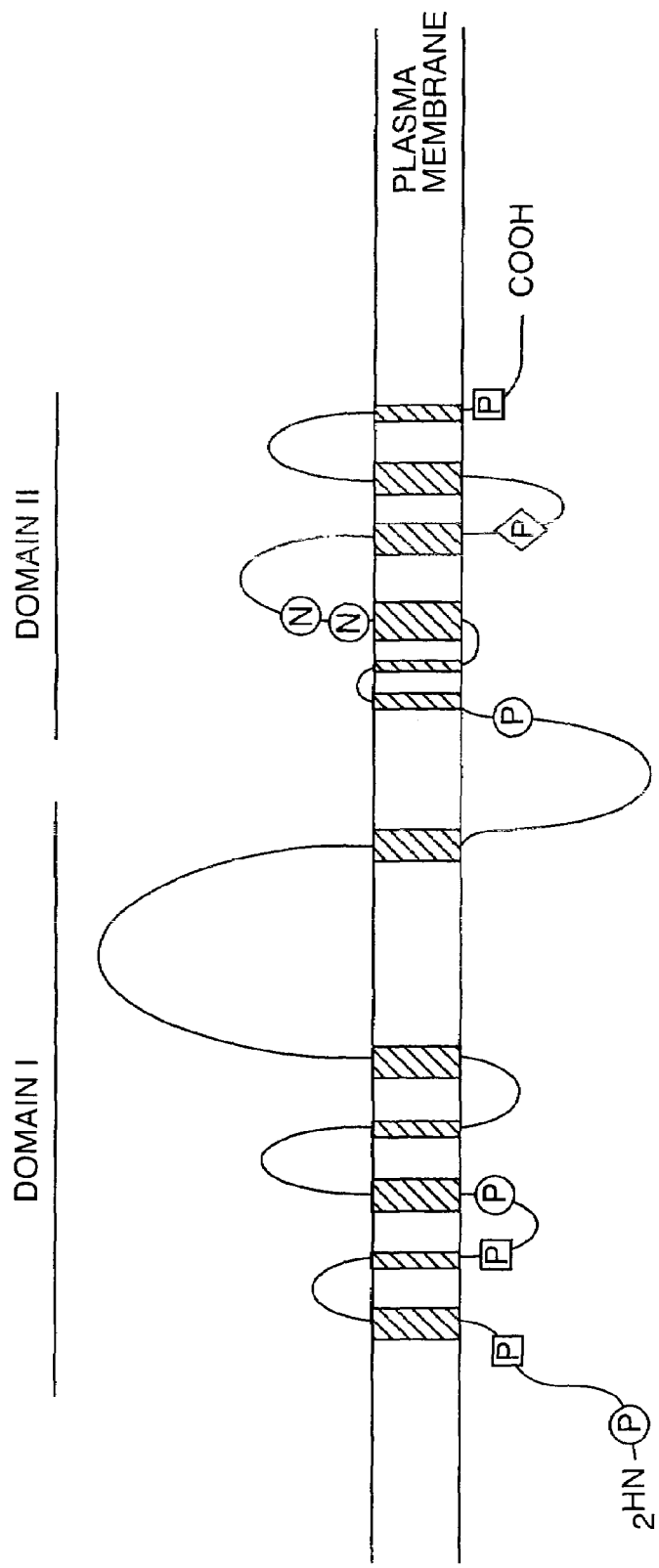
FIG. 23 represents a putative topology diagram of Zmax61A.
Figure 24:
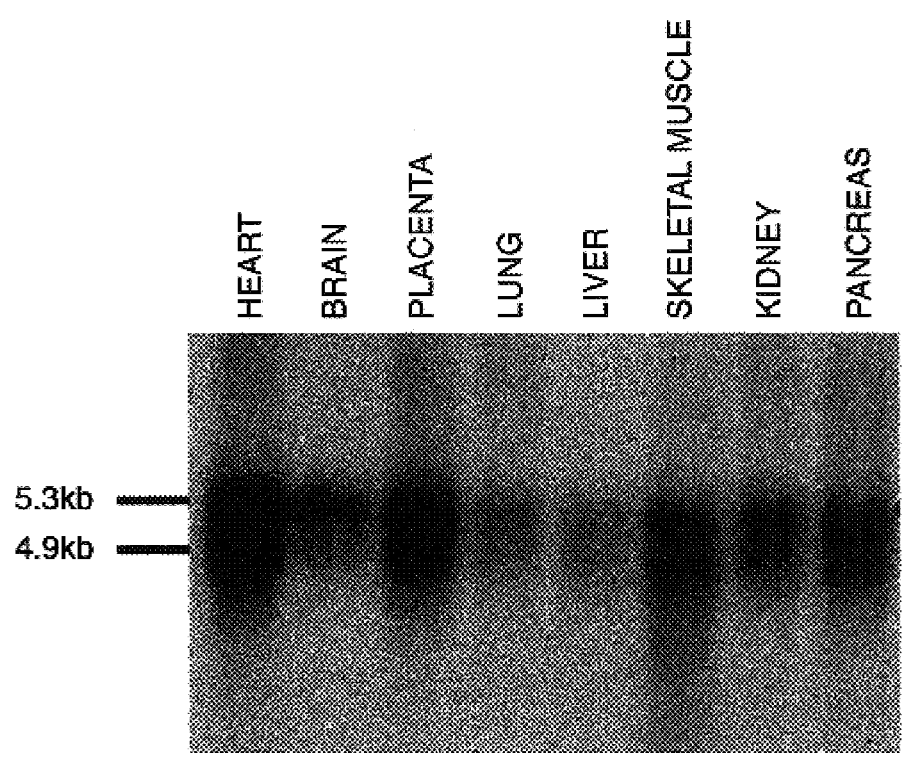
FIG. 24 represents the northern blot analysis of Zmax7A and Zmax7B showing the expression pattern in various tissues and the two different transcripts sizes of approximately 4.9 kb and 5.4 kb, respectively.
Figure 25:
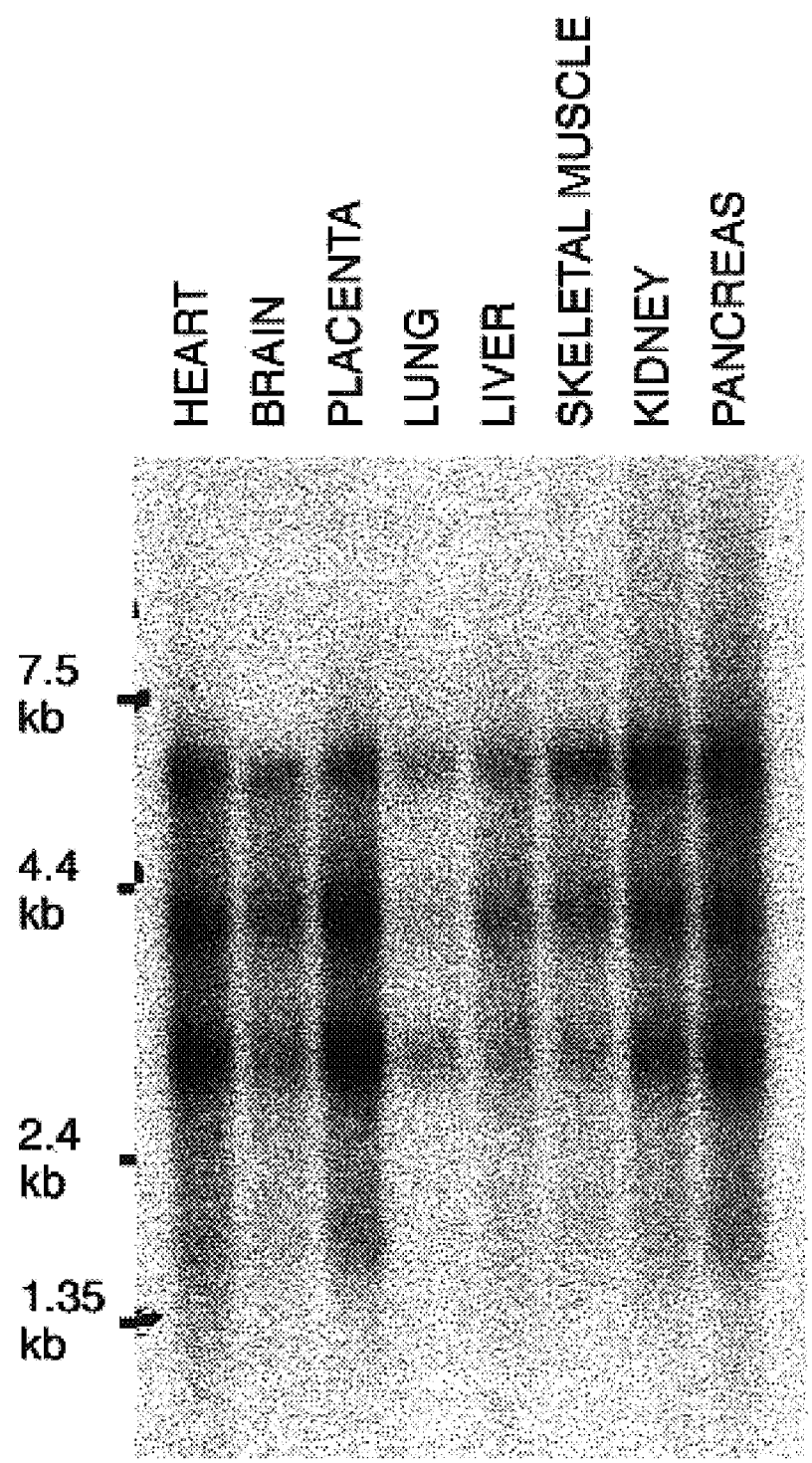
FIG. 25 represents the northern blot analysis of Zmax8A and Zmax8B showing the expression pattern in various tissues and the transcript size of approximately 3.5 kb and 6 kb, respectively.
Figure 26:
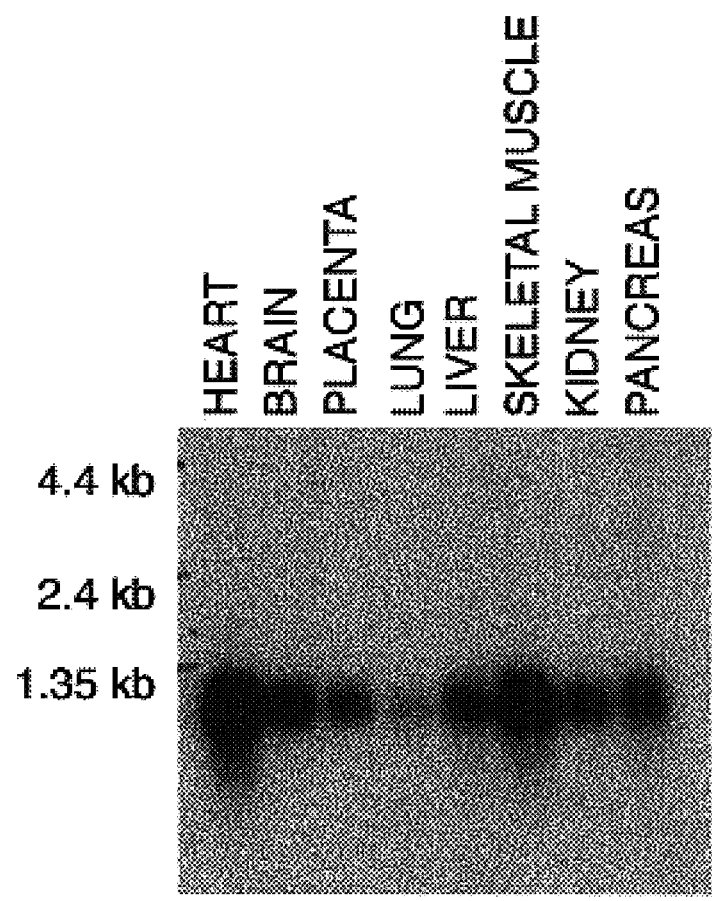
FIG. 26 represents the northern blot analysis of Zmax20 showing the expression pattern in various tissues and the transcript size of approximately 750 bp.
Figure 27:
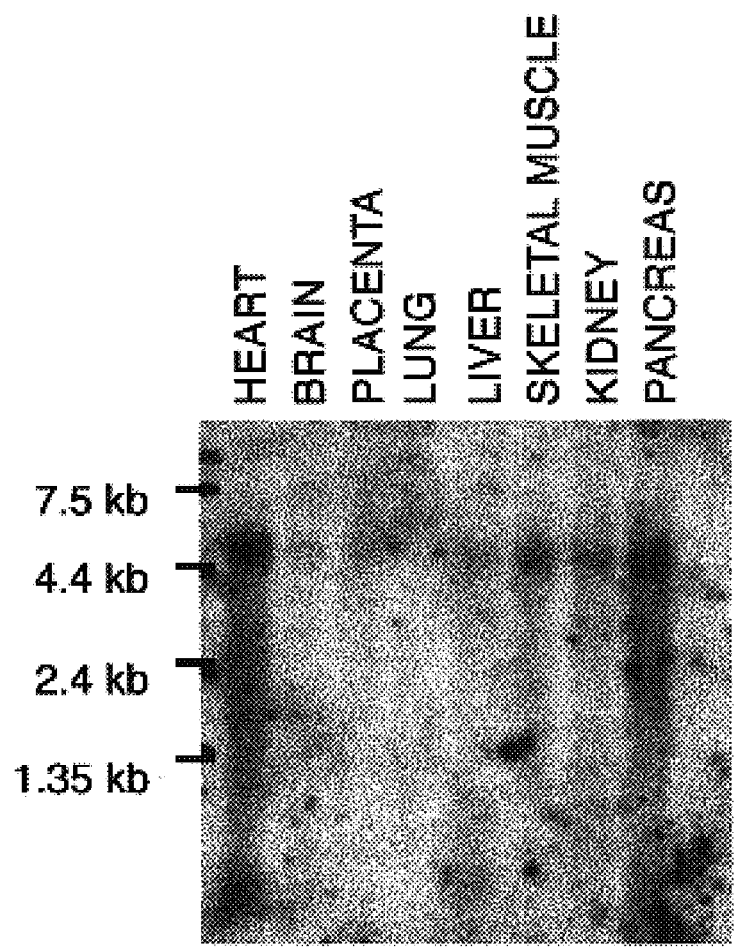
FIG. 27 represents the northern blot analysis of Zmax61A and Zmax61B showing the expression pattern in various tissues and each having the transcript size of approximately 5.4 kb.
Figure 28:
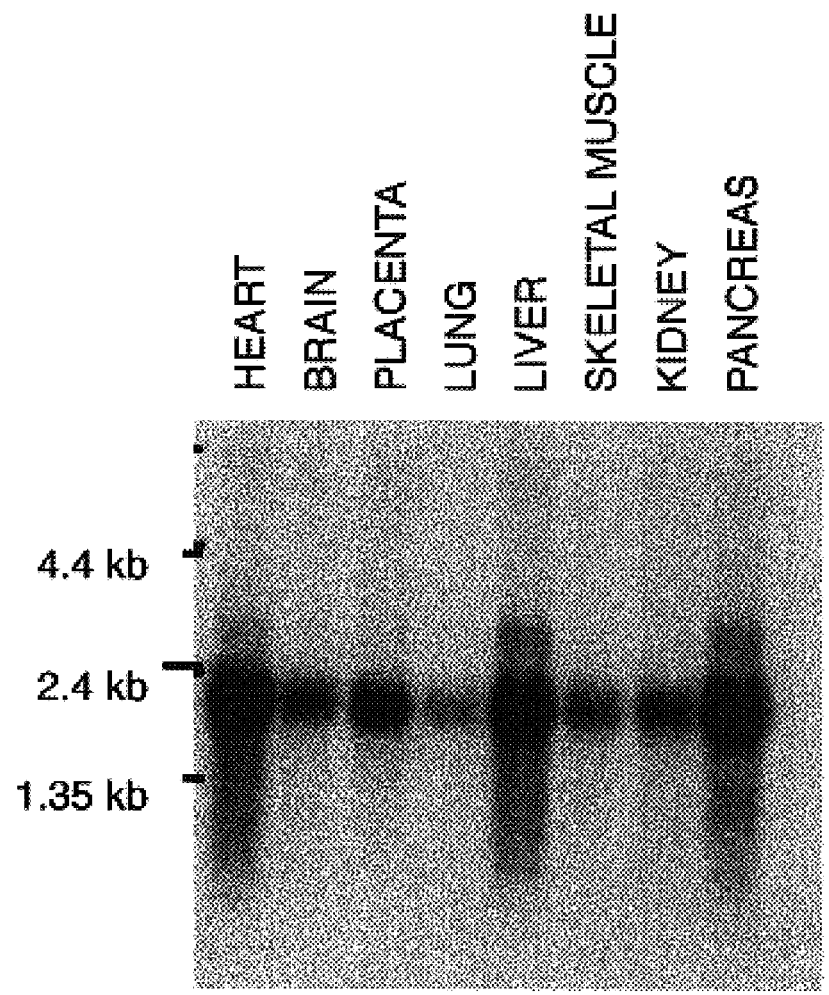
FIG. 28 is the northern blot analysis of Zmax113 showing the expression pattern in various tissues and the transcript size of 2.2 kb.

Zmax61 is alternatively spliced, and encodes two proteins—one of 584 amino acids in length (with a predicted Mr of 65403, Zmax61A) and the other of 752 amino acids (with a predicted Mr of 85300, Zmax61B). The difference in protein length is due to the addition of a single exon of 50 nt at position 1603 in the short form. This additional exon results in a frame shift after amino acid number 513 with the long form utilizing a different translation termination codon at position 2325 while the short form stop is at position 1821. Both forms of Zmax61 are similar in primary amino acid sequence to proteins of the ion channel family which include L-type calcium ion channels such as the dihydropyridine-sensitive L-type voltage-dependent calcium-channel receptor in skeletal muscle, as well as sodium and potassium channels. Ion channel function has been shown to be modulated via alternate splicing, for example in the cochlear lining cells where frequency response is related to the association of different subunits with different specific splice variants of the Slo ion channel family [Ramanathan K et al, Science 1999 Jan. 8;283(5399):215–7]. The topology of long form of the Zmax61 (FIG. 23) polypeptide is distinct from other calcium ion channels in that it does not contain four sets of transmembrane helices, rather it contains only two. This suggests that multimerization with other family members or alternatively spliced forms of product of the Zmax61 gene. Therefore, it is likely that the Zmax61 polypeptide represents a novel member of the L-type calcium channel family or is the first member of a previously undescribed class. Given the importance of ion channels in human biology (reviewed in Cooper and Jan, Proc. Natl. Acad. Sci USA 96: 4759–4766, 1999) it is likely that the development of molecules that alter the activity of the Zmax61 polypeptide will have great therapeutic benefit. For example, Monnier N et al., (Am J Hum Genet 1997 June; 60(6):1316–25) demonstrated that Malignant hyperthermia susceptibility (MHS) is caused by an amino acid substitution within the CACNL1A3 gene encoding the alpha 1-subunit of the human skeletal muscle dihydropyridine-sensitive L-type voltage-dependent calcium channel (VDCC). Another disorder, Hypokalemic periodic paralysis (hypoPP), is also caused by an amino acid substitution within the dihydropyridine receptor (Lapie P, Neuromuscul Disord 1997 June; 7(4):234–40). Hypertension is also caused by alterations in Calcium channel properties (Hermsmeyer K., Hypertension 1995 April; 25(4 Pt 2):731–4). Numerous nervous system (epilepsy, for example) and skeletal (malignant hyperthermia) and cardiac muscle (long QT) disorders have been linked to disturbances in ion channel biology Preparation of Nucleic Acids, Vectors, Transformations and Host Cells The nucleic acids of this invention can be produced in large quantities by replication in a suitable host cell. Natural or synthetic nucleic acid fragments, comprising at least ten contiguous bases coding for a desired peptide or polypeptide can be incorporated into recombinant nucleic acid constructs, usually DNA constructs, capable of introduction into and replication in a prokaryotic or eukaryotic cell. Usually the nucleic acid constructs will be suitable for replication in a unicellular host, such as yeast or bacteria, but may also be intended for introduction to (with and without integration within the genome) cultured mammalian or plant or other eukaryotic cells, cell lines, tissues, or organisms. The purification of nucleic acids produced by the methods of the present invention is described, for example, in Sambrook et al, *Molecular Cloning. A Laboratory Manual,* 2nd Ed. (Cold Spring Harbor Laboratory, Cold Spring Harbor, N.Y. (1989) or Ausubel et al, *Current Protocols in Molecular Biology,* J. Wiley and Sons, NY (1992).

The nucleic acids of the present invention can also be produced by chemical synthesis, e.g., by the phosphoramidite method described by Beaucage et al, *Tetra. Letts.,* 22:1859–1862 (1981) or the triester method according to Matteucci, et al, *J. Am. Chem. Soc.,* 103:3185 (1981), and can performed on commercial, automated oligonucleotide synthesizers. A double-stranded fragment may be obtained from the single-stranded product of chemical synthesis either by synthesizing the complementary strand and annealing the strands together under appropriate conditions or by adding the complementary strand using DNA polymerase with an appropriate primer sequence.

These nucleic acids can encode full-length variant forms of proteins as well as the naturally-occurring protein. The variant proteins (which could be especially useful for detection and treatment of disorders) will have the variant amino acid sequences encoded by the polymorphisms described in Table 2, when said polymorphisms are read so as to be in-frame with the full-length coding sequence of which it is a component.

Nucleic acid constructs prepared for introduction into a prokaryotic or eukaryotic host will comprise a replication system recognized by the host, including the intended nucleic acid fragment encoding the selected protein or polypeptide, and will preferably also include transcription and translational initiation regulatory sequences operably linked to the protein encoding segment. Expression vectors may include, for example, an origin of replication or autonomously replicating sequence (ARS) and expression control sequences, a promoter, an enhancer and necessary processing information sites, such as ribosome-binding sites, RNA splice sites, polyadenylation sites, transcriptional terminator sequences, and mRNA stabilizing sequences. Secretion signals are also included, where appropriate, whether from a native Zmax7A, Zmax7B, Zmax8A, Zmax8B, Zmax20, Zmax61A, Zmax61B, and Zmax113 protein or from other receptors or from secreted proteins of the same or related species, which allow the protein to cross and/or lodge in cell membranes, and thus attain its functional topology, or be secreted from the cell. Such vectors may be prepared by means of standard recombinant techniques well known in the art and discussed, for example, in Sambrook et al, *Molecular Cloning. A Laboratory Manual,* 2nd Ed. (Cold Spring Harbor Laboratory, Cold Spring Harbor, N.Y. (1989) or Ausubel et al, *Current Protocols in Molecular Biology,* J. Wiley and Sons, NY (1992).

An appropriate promoter and other necessary vector sequences will be selected so as to be functional in the host, and will include, when appropriate, those naturally associated with Zmax7A, Zmax7B, Zmax8A, Zmax8B, Zmax20, Zmax61A, Zmax61B, and Zmax113 genes. Examples of workable combinations of cell lines and expression vectors are described in Sambrook et al, *Molecular Cloning. A Laboratory Manual,* 2nd Ed. (Cold Spring Harbor Laboratory, Cold Spring Harbor, N.Y. (1989) or Ausubel et al, *Current Protocols in Molecular Biology,* J. Wiley and Sons, NY (1992). Many useful vectors are known in the art and can be obtained from such vendors as Stratagene (supra), New England BioLabs, Beverly, Mass., U.S.A, Promega Biotech, and other biotechnology product suppliers. Promoters such as the trp, lac and phage promoters, tRNA promoters and glycolytic enzyme promoters may be used in prokaryotic hosts. Useful yeast promoters include promoter regions for metallothionein, 3-phosphoglycerate kinase or other glycolytic enzymes such as enolase or glyceraldehyde-3-phosphate dehydrogenase, enzymes responsible for maltose and galactose utilization, and others. Vectors and promoters suitable for use in yeast expression are further described in EP 73,675A. Appropriate non-native mammalian promoters might include the early and late promoters from SV40 (Fiers et al, *Nature,* 273:113 (1978)) or promoters derived from murine Moloney leukemia virus, mouse tumor virus, avian sarcoma viruses, adenovirus II, bovine papilloma virus or polyoma. In addition, the construct may be joined to an amplifiable gene (e.g., DHFR) so that multiple copies of the gene may be made. For appropriate enhancer and other expression control sequences, see also

*Enhancers and Eukaryotic Gene Expression*, Cold Spring Harbor Press, Cold Spring Harbor, N.Y. (1983). While such expression vectors may replicate autonomously, they may also replicate by being inserted into the genome of the host cell, by methods well known in the art.

Expression and cloning vectors will likely contain a selectable marker, a gene encoding a protein necessary for survival or growth of a host cell transformed with the vector. The presence of this gene ensures growth of only those host cells which express the inserts. Typical selection genes encode proteins that a) confer resistance to antibiotics or other toxic substances, e.g. ampicillin, neomycin, methotrexate, etc.; b) complement auxotrophic deficiencies, or c) supply critical nutrients not available from complex media, e.g., the gene encoding D-alanine racemase for Bacilli. The choice of the proper selectable marker will depend on the host cell, and appropriate markers for different hosts are well known in the art.

The vectors containing the nucleic acids of interest can be transcribed in vitro, and the resulting RNA introduced into the host cell by well-known methods, e.g., by injection (see, Kubo et al, *FEBS Letts*. 241:119 (1988)), or the vectors can be introduced directly into host cells by methods well known in the art, which vary depending on the type of cellular host, including electroporation; transfection employing calcium chloride, rubidium chloride, calcium phosphate, DEAE-dextran, or other substances; microprojectile bombardment; lipofection; infection (where the vector is an infectious agent, such as a retroviral genome); and other methods. See generally, Sambrook et al., 1989 and Ausubel et al., 1992. The introduction of the nucleic acids into the host cell by any method known in the art, including those described above, will be referred to herein as "transformation." The cells into which have been introduced nucleic acids described above are meant to also include the progeny of such cells.

Large quantities of the nucleic acids and proteins of the present invention may be prepared by expressing the Zmax7A, Zmax7B, Zmax8A, Zmax8B, Zmax20, Zmax61A, Zmax61B, and Zmax113 nucleic acids or portions thereof in vectors or other expression vehicles in compatible prokaryotic or eukaryotic host cells. The most commonly used prokaryotic hosts are strains of *Escherichia coli*, although other prokaryotes, such as *Bacillus subtilis* or *Pseudomonas* may also be used.

Mammalian or other eukaryotic host cells, such as those of yeast, filamentous fungi, plant, insect, or amphibian or avian species, may also be useful for production of the proteins of the present invention. Propagation of mammalian cells in culture is per se well known. See, Jakoby and Pastan (eds.), *Cell Culture. Methods in Enzymology*, volume 58, Academic Press, Inc., Harcourt Brace Jovanovich, NY, (1979)). Examples of commonly used mammalian host cell lines are VERO and HeLa cells, Chinese hamster ovary (CHO) cells, and WI38, BHK, and COS cell lines, although it will be appreciated by the skilled practitioner that other cell lines may be appropriate, e.g., to provide higher expression desirable glycosylation patterns, or other features.

Clones are selected by using markers depending on the mode of the vector construction. The marker may be on the same or a different DNA molecule, preferably the same DNA molecule. In prokaryotic hosts, the transformant may be selected, e.g., by resistance to ampicillin, tetracycline or other antibiotics. Production of a particular product based on temperature sensitivity may also serve as an appropriate marker.

Prokaryotic or eukaryotic cells transformed with the nucleic acids of the present invention will be useful not only for the production of the nucleic acids and proteins of the present invention, but also, for example, in studying the characteristics of Zmax7A, Zmax7B, Zmax8A, Zmax8B, Zmax20, Zmax61A, Zmax61B, and Zmax113 proteins.

Antisense nucleic acid sequences are useful in preventing or diminishing the expression of Zmax7A, Zmax7B, Zmax8A, Zmax8B, Zmax20, Zmax61A, Zmax61B, and Zmax113 genes, as will be appreciated by one skilled in the art. For example, nucleic acid vectors containing all or a fragment of Zmax7A, Zmax7B, Zmax8A, Zmax8B, Zmax20, Zmax61A, Zmax61B, and Zmax113 A, Zmax 7b, Zmax 8, Zmax 20, Zmax 61 and Zmax 113 genes, complementary sequences of the former, or other sequences from the HBM region may be placed under the control of a promoter in an antisense orientation and introduced into a cell. Expression of such an antisense construct within a cell will interfere with Zmax7A, Zmax7B, Zmax8A, Zmax8B, Zmax20, Zmax61A, Zmax61B, and Zmax113 transcription and/or translation and/or replication.

The probes and primers based on the Zmax7A, Zmax 7b, Zmax 8, Zmax 20, Zmax 61 and Zmax 113 gene sequences disclosed herein are used to identify homologous Zmax7A, Zmax7B, Zmax8A, Zmax8B, Zmax20, Zmax61A, Zmax61B, and Zmax113 gene sequences and proteins in other species. These Zmax7A, Zmax7B, Zmax8A, Zmax8B, Zmax20, Zmax61A, Zmax61B, and Zmax 113 gene sequences and proteins are used in the diagnostic/prognostic, therapeutic and drug screening methods described herein for the species from which they have been isolated.

Protein Expression and Purification

Expression and purification of the Zmax7A, Zmax 7b, Zmax 8, Zmax 20, Zmax 61 or Zmax 113 protein of the invention can be performed essentially as outlined below. To faciliate the cloning, expression and purification of membrane and secreted protein from the HBM region, a gene expression system, such as the pET System (Novagen), for cloning and expression of recombinant proteins in *E. coli* is selected. Also, a DNA sequence encoding a peptide tag, the His-Tap, is fused to the 3' end of DNA sequences of interest to facilitate purification of the recombinant protein products. The 3' end is selected for fusion to avoid alteration of any 5' terminal signal sequence.

Nucleic acids chosen, for example, from the nucleic acids set forth in SEQ ID NOS: 1–8, or SEQ ID NOS:17–27 for cloning the genes are prepared by polymerase chain reaction (PCR). Synthetic oligonucleotide primers specific for the 5' and 3' ends of the nucleotide sequences are designed and purchased from Life Technologies (Gaithersburg, Md.). All forward primers (specific for the 5' end of the sequence) are designed to include an NcoI cloning site at the 5' terminus. These primers are designed to permit initiation of protein translation at the methionine residue encoded within the NcoI site followed by a valine residue and the protein encoded by the DNA sequence. All reverse primers (specific for the 3' end of the sequence) include an EcoRI site at the 5' terminus to permit cloning of the sequence into the reading frame of the pET-28b. The pET-28b vector provides a sequence encoding an additional 20 carboxyl-terminal amino acids including six histidine residues (at the C-terminus), which comprise the histidine affinity tag.

Genomic DNA prepared from the HBM region is used as the source of template DNA for PCR amplification (Ausubel et al, *Current Protocols in Molecular Biology*, John Wilty & Sons (1994)). To amplify a DNA sequence containing the nucleotide sequence, genomic DNA (50 ng) is introduced into a reaction vial containing 2 mM $MgCl_2$, 1 micromolar synthetic oligonucleotide primers (forward and reverse primers) complementary to and flanking a defined HBM region, 0.2 mM of each of deoxynucleotide triphosphate, dATP, dGTP, dCTP, dTTP and 2.5 units of heat stable DNA polymerase (Amplitaq, Roche Molecular Systems, Inc., Branchburg, N.J.) in a final volume of 100 microliters.

Upon completion of thermal cycling reactions, each sample of amplified DNA is purified using the Qiaquick Spin PCR purification kit (Qiagen, Gaithersburg, Md.). All amplified DNA samples are subjected to digestion with the restriction endonucleases, e.g., NcoI and EcoRI (New England BioLabs, Beverly, Mass., U.S.A.) (Ausubel et al, *Current Protocols in Molecular Biology*, John Wiley & Sons, Inc. (1994)). DNA samples are then subjected to electrophoresis on 1.0% NuSeive (FMC BioProducts, Rockland, Me.) agarose gels. DNA is visualized by exposure to ethidium bromide and long wave UV irradiation. DNA contained in slices isolated from the agarose gel are purified using the Bio 101 GeneClean Kit protocol (Bio 101, Vista, Calif.).

The pET-28b vector is prepared for cloning by digestion with restriction endonucleases, e.g., NcoI and EcoRI (New England BioLabs, Beverly, Mass.) (Ausubel et al, *Current Protocols in Molecular Biology*, John Wiley & Sons, Inc. (1994)). The pET-28a vector, which encodes the histidine affinity tag that can be fused to the 5' end of an inserted gene, is prepared by digestion with appropriate restriction endonucleases.

Following digestion, DNA inserts are cloned (Ausubel et al, *Current Protocols in Molecular Biology*, John Wiley & Sons, Inc. (1994)) into the previously digested pET-28b expression vector. Products of the ligation reaction are then used to transform the BL21 strain of *E. coli* (Ausubel et al, *Current Protocols in Molecular Biology*, John Wiley & Sons, Inc. (1994)) as described below.

Competent bacteria, *E. coli* strain BL21 or *E. coli* strain BL21 (DE3), are transformed with recombinant pET expression plasmids carrying the cloned sequence according to standard methods (Ausubel et al, *Current Protocols in Molecular Biology*, John Wiley & Sons, Inc. (1994)). Briefly, 1 microliter of ligation reaction is mixed with 50 microliters of electrocompetent cells and subjected to a high voltage pulse, after which samples were incubated in 0.45 ml SOC medium (0.5% yeast extract, 2.0% tryptone, 10 mM NaCl, 2.5 mM KCl, 10 mM $MgCl_2$, 10 mM $MgSO_4$ and 20 mM glucose) at 37° C. with shaking for 1 hour. Samples are then spread on LB agar plates containing 25 μg/ml kanamycin sulfate for growth overnight. Transformed colonies of BL21 are then picked and analyzed to evaluate cloned inserts, as described below.

Individual BL21 clones transformed with recombinant pET-28b HBM nucleotide sequences are analyzed by PCR amplification of the cloned inserts using the same forward and reverse primers specific for the HBM sequences that are used in the original PCR amplification cloning reactions. Successful amplification verifies the integration of the sequence in the expresssion vector (Ausubel et al, *Current Protocols in Molecular Biology*, John Wiley & Sons, Inc. (1994)).

Individual clones of recombinant pET-28b vectors carrying properly cloned HBM nucleotide sequences are picked and incubated in 5 ml of LB broth plus 25 μg/ml kanamycin sulfate overnight. The following day plasmid DNA is isolated and purified using the Qiagen plasmid purification protocol (Qiagen Inc., Chatsworth, Calif.).

The pET vector can be propagated in any *E. coli* K-12 strain, e.g., HMS174, HB101, JM109, DH5 and the like, for purposes of cloning or plasmid preparation. Hosts for expression include *E. coli* strains containing a chromosomal copy of the gene for T7 RNA polymerase. These hosts are lysogens of bacteriophage DE3, a lambda derivative that carries the lacI gene, the lacUV5 promoter and the gene for T7 RNA polymerase. T7 RNA polymerase is induced by addition of isopropyl--D-thiogalactoside (IPTG), and the T7 RNA polymerase transcribes any target plasmid containing a functional T7 promoter, such as pET-28b, carrying its gene of interest. Strains include, for example, BL21(DE3) (Studier et al, *Meth. Enzymol.*, 185:60–89 (1990)).

To express the recombinant sequence, 50 ng of plasmid DNA are isolated as described above to transform competent BL21(DE3) bacteria as described above (provided by Novagen as part of the pET expression kit). The lacZ gene (-galactosidase) is expressed in the pET-System as described for the HBM recombinant constructions. Transformed cells were cultured in SOC medium for 1 hour, and the culture is then plated on LB plates containing 25 μg/ml kanamycin sulfate. The following day, the bacterial colonies are pooled and grown in LB medium containing kanamycin sulfate (25 μg/ml) to an optical density at 600 nM of 0.5 to 1.0 O.D. units, at which point 1 mM IPTG was added to the culture for 3 hours to induce gene expression of the HBM recombinant DNA constructions.

After induction of gene expression with IPTG, bacteria are collected by centrifugation in a Sorvall RC-3B centrifuge at 3500×g for 15 minutes at 4° C. Pellets are resuspended in 50 ml of cold mM Tris-HCl, pH 8.0, 0.1 M NaCl and 0.1 mM EDTA (STE buffer). Cells are then centrifuged at 2000×g for 20 minutes at 4° C. Wet pellets are weighed and frozen at −80° C. until ready for protein purification.

A variety of methodologies known in the art can be used to purify the isolated proteins (Coligan et al, *Current Protocols in Protein Science*, John Wiley & Sons (1995)). For example, the frozen cells can be thawed, resuspended in buffer and ruptured by several passages through a small volume microfluidizer (Model M-110S, Microfluidics International Corp., Newton, Mass.). The resultant homogenate is centrifuged to yield a clear supernatant (crude extract) and, following filtration, the crude extract is fractioned over columns. Fractions are monitored by absorance at $OD_{280}$ nm and peak fractions may be analyzed by SDS-PAGE.

The concentrations of purified protein preparations are quantified spectrophotometrically using absorbance coefficients calculated from amino acid content (Perkins, *Eur. J. Biochem.*, 157:169–180 (1986)). Protein concentrations are also measured by the method of Bradford, *Anal. Biochem.*, 72:248–254 (1976) and Lowry et al, *J. Biol. Chem.*, 193: 265–275 (1951) using bovine serum albumin as a standard.

SDS-polyacrylamide gels of various concentrations are purchased from BioRad (Hercules, Calif.), and stained with Coomassie blue. Molecular weight markers may include rabbit skeletal muscle myosin (200 kDa), *E. coli*-galactosidase (116 kDa), rabbit muscle phosphorylase B (97.4 kDa), bovine serum albumin (66.2 kDa), ovalbumin (45 kDa), bovine carbonic anyhdrase (31 kDa), soybean trypsin inhibitor (21.5 kDa), egg white lysozyme (14.4 kDa) and bovine aprotinin (6.5 kDa).

Proteins can also be isolated by other conventional means of protein biochemistry and purification to obtain a substantially pure product, i.e., 80, 95, or 99% free of cell component contaminants, as described in Jacoby, *Methods in Enzymology*, Vol. 104, Academic Press, New York (1984); Scoopes, *Protein Purification, Principles and Practice*, $2^{nd}$ Ed., springer-Verlag, New York (1987); and Deutscher (ed.), *Guide to Protein Purification, Methods in Enzymology*, Vol.

182 (1990). If the protein is secreted, it can be isolated from the supernatant in which the host cell is grown; otherwise, it can be isolated from a lysate of the host cells.

Once a sufficient quantity of the desired protein has been obtained, it may be used for various purposes. One use of the protein or polypeptide is the production of antibodies specific for binding. These antibodies may be either polyclonal or monoclonal, and may be produced by in vitro or in vivo techniques well known in the art. Monoclonal antibodies to epitopes of any of the peptides identified and isolated as described can be prepared from murine hybridomas (Kohler, *Nature,* 256:495 (1975)). In summary, a mouse is inoculated with a few micrograms of protein over a period of two weeks. The mouse is then sacrificed. The cells that produce antibodies are then removed from the mouse's spleen. The spleen cells are then fused with polyethylene glycol with mouse myeloma cells. The successfully fused cells are diluted in a microtiter plate and growth of the culture is continued. The amount of antibody per well is measured by immunoassay methods such as ELISA (Engvall, *Meth. Enzymol.,* 70:419 (1980)). Clones producing antibody can be expanded and further propagated to produce protein antibodies. Other suitable techniques involve in vitro exposure of lymphocytes to the antigenic polypeptides, or alternatively, to selection of libraries of antibodies in phage or similar vectors. See Huse et al, *Science,* 246:1275–1281 (1989). For additional information on antibody production see Davis et al, *Basic Methods in Molecular Biology,* Elsevier, N.Y., Section 21–2 (1989). Such antibodies are particularly useful in diagnostic assays for detection of variant protein forms, or as an active ingredient in a pharmaceutical composition.

Transformed Hosts, Development of Pharmaceuticals and Research Tools

Cells and animals that carry the Zmax7A, Zmax7B, Zmax8A, Zmax8B, Zmax20, Zmax61A, Zmax61B, and Zmax113 genes can be used as model systems to study and test for substances that have potential as therapeutic agents (Onyia et al, *J. Bone Miner. Res.,* 13:20–30 (1998); Broder et al, *Bone,* 21:225–235 (1997)). The cells are typically cultured mesenchymal stem cells. These may be isolated from individuals with somatic or germline Zmax7A, Zmax7B, Zmax8A, Zmax8B, Zmax20, Zmax61A, Zmax61B, and Zmax113 gene. Alternatively, the cell line can be engineered to carry the Zmax7A, Zmax7B, Zmax8A, Zmax8B, Zmax20, Zmax61A, Zmax61B, and Zmax113 genes, as described above. After a test substance is applied to the cells, the transformed phenotype of the cell is determined. Any trait of transformed cells can be assessed, including formation of bone matrix in culture (Broder et al, *Bone,* 21:225–235 (1997)), mechanical properties (Kizer et al, *Proc. Natl. Acad. Sci. USA,* 94:1013–1018 (1997)), and response to application of putative therapeutic agents.

Diagnostic Applications

As discussed herein, chromosomal region 11q13 has been genetically linked to a variety of diseases and disorders. The inventors provide nucleic acids and SNPs which can be useful in diagnosing individuals with chromosomal abnormalities linked to these diseases. In particular, Zmax 61 is most likely an ion channel gene which can be used to identify individuals with neurological and muscular disorders.

Antibody-based diagnostic methods: The invention provides methods for detecting disease-associated antigenic components in a biological sample, which methods comprise the steps of: (i) contacting a sample suspected to contain an disease-associated antigenic component with an antibody specific for an disease-associated antigen, extracellular or intracellular, under conditions in which a stable antigen-antibody complex can form between the antibody and disease-associated antigenic components in the sample; and (ii) detecting any antigen-antibody complex formed in step (i) using any suitable means known in the art, wherein the detection of a complex indicates the presence of disease-associated antigenic components in the sample. It will be understood that assays that utilize antibodies directed against sequences previously unidentified, or previously unidentified as being disease-associated, which sequences are disclosed herein, are within the scope of the invention.

Many immunoassay formats are known in the art, and the particular format used is determined by the desired application. An immunoassay can use, for example, a monoclonal antibody directed against a single disease-associated epitope, a combination of monoclonal antibodies directed against different epitopes of a single disease-associated antigenic component, monoclonal antibodies directed towards epitopes of different disease-associated antigens, polyclonal antibodies directed towards the same disease-associated antigen, or polyclonal antibodies directed towards different disease-associated antigens. Protocols can also, for example, use solid supports, or may involve immunoprecipitation.

Typically, immunoassays use either a labeled antibody or a labeled antigenic component (e.g., that competes with the antigen in the sample for binding to the antibody). Suitable labels include without limitation enzyme-based, fluorescent, chemiluminescent, radioactive, or dye molecules. Assays that amplify the signals from the probe are also known, such as, for example, those that utilize biotin and avidin, and enzyme-labeled immunoassays, such as ELISA assays.

Kits suitable for antibody-based diagnostic applications typically include one or more of the following components:

(i) Antibodies: The antibodies may be pre-labeled; alternatively, the antibody may be unlabeled and the ingredients for labeling may be included in the kit in separate containers, or a secondary, labeled antibody is provided; and (ii) Reaction components: The kit may also contain other suitably packaged reagents and materials needed for the particular immunoassay protocol, including solid-phase matrices, if applicable, and standards.

The kits referred to above may include instructions for conducting the test. Furthermore, in preferred embodiments, the diagnostic kits are adaptable to high-throughput and/or automated operation.

Nucleic-acid-based diagnostic methods: The invention provides methods for detecting disease-associated nucleic acids in a sample, such as in a biological sample, which methods comprise the steps of: (i) contacting a sample suspected to contain an disease-associated nucleic acid with one or more disease-associated nucleic acid probes under conditions in which hybrids can form between any of the probes and disease-associated nucleic acid in the sample; and (ii) detecting any hybrids formed in step (i) using any suitable means known in the art, wherein the detection of hybrids indicates the presence of the disease-associated nucleic acid in the sample. To detect disease-associated nucleic acids present in low levels in biological samples, it may be necessary to amplify the disease-associated sequences or the hybridization signal as part of the diagnostic assay. Techniques for amplification are known to those of skill in the art.

Disease-associated nucleic acids useful as probes in diagnostic methods include oligonucleotides at least about 15 nucleotides in length, preferably at least about 20 nucleotides in length, and most preferably at least about 25–55 nucleotides in length, that hybridize specifically with one or more disease-associated nucleic acids.

A sample to be analyzed, such as, for example, a tissue sample, may be contacted directly with the nucleic acid probes. Alternatively, the sample may be treated to extract the nucleic acids contained therein. It will be understood that the particular method used to extract DNA will depend on the nature of the biological sample. The resulting nucleic acid from the sample may be subjected to gel electrophoresis or other size separation techniques, or, the nucleic acid sample may be immobilized on an appropriate solid matrix without size separation.

Kits suitable for nucleic acid-based diagnostic applications typically include the following components:

(i) Probe DNA: The probe DNA may be prelabeled; alternatively, the probe DNA may be unlabeled and the ingredients for labeling may be included in the kit in separate containers; and (ii) Hybridization reagents: The kit may also contain other suitably packaged reagents and materials needed for the particular hybridization protocol, including solid-phase matrices, if applicable, and standards.

In cases where a disease condition is suspected to involve an alteration of the disease gene, specific oligonucleotides may be constructed and used to assess the level of disease mRNA in cell affected or other tissue affected by the disease.

For example, to test whether a person has a disease gene, polymerase chain reaction can be used. Two oligonucleotides are synthesized by standard methods or are obtained from a commercial supplier of custom-made oligonucleotides. The length and base composition are determined by standard criteria using the Oligo 4.0 primer Picking program (Wojchich Rychlik, 1992). One of the oligonucleotides is designed so that it will hybridize only to the disease gene DNA under the PCR conditions used. The other oligonucleotide is designed to hybridize a segment of genomic DNA such that amplification of DNA using these oligonucleotide primers produces a conveniently identified DNA fragment. Tissue samples may be obtained from hair follicles, whole blood, or the buccal cavity. The DNA fragment generated by this procedure is sequenced by standard techniques.

Other amplification techniques besides PCR may be used as alternatives, such as ligation-mediated PCR or techniques involving Q-beta replicase (Cahill et al, *Clin. Chem.*, 37(9): 1482–5 (1991)). Products of amplification can be detected by agarose gel electrophoresis, quantitative hybridization, or equivalent techniques for nucleic acid detection known to one skilled in the art of molecular biology (Sambrook et al, *Molecular Cloning: A Laboratory Manual*, Cold Spring Harbor Laboratory, Cold Spring, N.Y. (1989)). Other alterations in the disease gene may be diagnosed by the same type of amplification-detection procedures, by using oligonucleotides designed to identify those alterations.

Genomic Screening

The use of polymorphic genetic markers linked to the Zmax7A, Zmax7B, Zmax8A, Zmax8B, Zmax20, Zmax61A, Zmax61B, and Zmax113 genes are very useful in predicting susceptibility to the diseases genetical linked to 11q13. Koller et al, *Amer. J Bone Min. Res.*, 13:1903–1908 (1998) have demonstrated that the use of polymorphic genetic markers is useful for linkage analysis. Similarly, as provided in Table 2, the identification of polymorphic genetic markers within the Zmax7A, Zmax7B, Zmax8A, Zmax8B, Zmax20, Zmax61A, Zmax61B, and Zmax113 genes will allow the identification of specific allelic variants that are in linkage disequilibrium with other genetic lesions that affect one of the disease states discussed herein including neurological or muscle disorders. Using the DNA sequence from the BACs, a dinucleotide repeat was identified and two unique PCR primers that will amplify the genomic DNA containing this repeat were designed, as shown below:

B200E21C16_L: GAGAGGCTATATCCCTGGGC (SEQ ID NO: 57),

B200E21C16_R: ACAGCACGTGTTTAAAGGGG (SEQ ID NO: 58), and used in the genetic mapping study.

This method has been used successfully by others skilled in the art (e.g., Sheffield et al, *Genet.*, 4:1837–1844 (1995); LeBlanc-Straceski et al, *Genomics*, 19:341–9 (1994); Chen et al, *Genomics*, 25:1–8 (1995)). Use of these reagents with populations or individuals will predict their risk for disease described herein including neurological and muscular disorders.

Treatment of Disorders.

Thus, the present invention provides methods of screening for drugs comprising contacting such an agent with a novel protein of this invention or fragment thereof and assaying (i) for the presence of a complex between the agent and the protein or fragment, or (ii) for the presence of a complex between the protein or fragment and a ligand, by methods well known in the art. In such competitive binding assays the novel protein or fragment is typically labeled. Free protein or fragment is separated from that present in a protein:protein complex, and the amount of free (ie., uncomplexed) label is a measure of the binding of the agent being tested to the novel protein or its interference with protein ligand binding, respectively. This invention also contemplates the use of competitive drug screening assays in which neutralizing antibodies capable of specifically binding the Zmax7A, Zmax7B, Zmax8A, Zmax8B, Zmax20, Zmax61A, Zmax61B or Zmax113 protein compete with a test compound for binding to the Zmax7A, Zmax7B, Zmax8A, Zmax8B, Zmax20, Zmax61A, Zmax61B or Zmax113 protein or fragments thereof. In this manner, the antibodies can be used to detect the presence of any peptide which shares one or more antigenic determinants of a Zmax7A, Zmax7B, Zmax8A, Zmax8B, Zmax20, Zmax61A, Zmax61B or Zmax113 protein.

The goal of rational drug design is to produce structural analogs of biologically active proteins of interest or of small molecules with which they interact (e.g., agonists, antagonists, inhibitors) in order to fashion drugs which are, for example, more active or stable forms of the protein, or which, e.g., enhance or interfere with the function of a protein in vivo. See, e.g., Hodgson, *Bio/Technology*, 9:19–21 (1991). In one approach, one first determines the three-dimensional structure of a protein of interest or, for example, of the Zmax7A, Zmax7B, Zmax8A, Zmax8B, Zmax20, Zmax61A, Zmax61B or Zmax113 receptor or ligand complex, by x-ray crystallography, by computer modeling or most typically, by a combination of approaches. Less often, useful information regarding the structure of a protein may be gained by modeling based on the structure of homologous proteins. An example of rational drug design is the development of HIV protease inhibitors (Erickson et al, *Science*, 249:527–533 (1990)). In addition, peptides (e.g., Zmax7A, Zmax7B, Zmax8A, Zmax8B, Zmax20, Zmax61A, Zmax61B or Zmax113 protein) are analyzed by an alanine scan (Wells, *Methods in Enzymol.*, 202:390–411 (1991)). In this technique, an amino acid residue is replaced by Ala, and its effect on the peptide's activity is determined. Each of the amino acid residues of the peptide is analyzed in this manner to determine the important regions of the peptide.

It is also possible to isolate a target-specific antibody, selected by a functional assay, and then to solve its crystal structure. In principle, this approach yields a pharmacore upon which subsequent drug design can be based. It is possible to bypass protein crystallography altogether by generating anti-idiotypic antibodies (anti-ids) to a functional, pharmacologically active antibody. As a mirror image of a mirror image, the binding site of the anti-ids would be expected to be an analog of the original receptor. The anti-id could then be used to identify and isolate peptides from banks of chemically or biologically produced banks of peptides. Selected peptides would then act as the pharmacore.

Thus, one may design drugs which have, e.g., improved Zmax7A, Zmax7B, Zmax8A, Zmax8B, Zmax20, Zmax61A, Zmax61B or Zmax113 protein activity or stability or which act as inhibitors, agonists, antagonists, etc. of Zmax7A, Zmax7B, Zmax8A, Zmax8B, Zmax20, Zmax61A, Zmax61B or Zmax113 protein activity. By virtue of the availability of cloned Zmax7A, Zmax7B, Zmax8A, Zmax8B, Zmax20, Zmax61A, Zmax61B or Zmax113 gene sequences, sufficient amounts of the Zmax7A, Zmax7B, Zmax8A, Zmax8B, Zmax20, Zmax61A, Zmax61B or Zmax113 protein may be made available to perform such analytical studies as x-ray crystallography. In addition, the knowledge of the Zmax7A, Zmax7B, Zmax8A, Zmax8B, Zmax20, Zmax61A, Zmax61B or Zmax113 protein sequence will guide those employing computer modeling techniques in place of, or in addition to x-ray crystallography.

Cells and animals that carry the Zmax7A, Zmax7B, Zmax8A, Zmax8B, Zmax20, Zmax61A, Zmax61B or Zmax113 gene or an analog thereof can be used as model systems to study and test for substances that have potential as therapeutic agents. After a test substance is applied to the cells, the transformed phenotype of the cell is determined.

The therapeutic agents and compositions of the present invention are useful for preventing or treating respiratory disease. pharmaceutical formulations suitable for therapy comprise the active agent in conjunction with one or more biologically acceptable carriers. Suitable biologically acceptable carriers include, but are not limited to, phosphate-buffered saline, saline, deionized water, or the like. Preferred biologically acceptable carriers are physiologically or pharmaceutically acceptable carriers.

The compositions include an effective amount of active agent. Effective amounts are those quantities of the active agents of the present invention that afford prophyladic protection against a respiratory disease, or which result in amelioration or cure of an existing respiratory disease. prophylactic methods incorporate a prophylactically effective amount of an active agent or composition. A prophylactically effective amount is an amount effective to prevent disease. Treatment methods incorporate a therapeutically effective amount of an active agent or composition. A therapeutically effective amount is an amount sufficient to ameliorate or eliminate the symptoms of disease. The effective amount will depend upon the agent, the severity of disease and the nature of the disease, and the particular host. The amount can be determined by experimentation known in the art, such as by establishing a matrix of dosage amounts and frequencies of dosage administration and comparing a group of experimental units or subjects to each point in the matrix. The prophylactically and/or therapeutically effective amounts can be administered in one administration or over repeated administrations. Therapeutic administration can be followed by prophylactic administration, once initial clinical symptoms of disease have been resolved.

The agents and compositions can be administered topically or systemically. Systemic administration includes both oral and parental routes. Parental routes include, without limitation, subcutaneous, intramuscular, intraperitoneal, intravenous, transdermal, and intranasal administration.

Gene Therapy

In recent years, significant technological advances have been made in the area of gene therapy for both genetic and acquired diseases. (Kay et al, *Proc. Natl. Acad. Sci. USA*, 94:12744–12746 (1997)) Gene therapy can be defined as the deliberate transfer of DNA for therapeutic purposes. Improvement in gene transfer methods has allowed for development of gene therapy protocols for the treatment of diverse types of diseases. Gene therapy has also taken advantage of recent advances in the identification of new therapeutic genes, improvement in both viral and nonviral gene delivery systems, better understanding of gene regulation, and improvement in cell isolation and transplantation. Gene therapy would be carried out according to generally accepted methods as described by, for example, Friedman, *Therapy for Genetic Diseases*, Friedman, Ed., Oxford University Press, pages 105–121 (1991).

Vectors for introduction of genes both for recombination and for extrachromosomal maintenance are known in the art, and any suitable vector may be used. Methods for introducing DNA into cells such as electroporation, calcium phosphate co-precipitation, and viral transduction are known in the art, and the choice of method is within the competence of one skilled in the art (Robbins, Ed., *Gene Therapy Protocols*, Human Press, NJ (1997)). Cells transformed with a Zmax7A, Zmax7B, Zmax8A, Zmax8B, Zmax20, Zmax61A, Zmax61B or Zmax113 gene can be used as model systems to study chromosome 11 disorders and to identify drug treatments for the treatment of such disorders.

Gene transfer systems known in the art may be useful in the practice of the gene therapy methods of the present invention. These include viral and nonviral transfer methods. A number of viruses have been used as gene transfer vectors, including polyoma, i.e., SV40 (Madzak et al, *J. Gen. Virol.*, 73:1533–1536 (1992)), adenovirus (Berkner, *Curr. Top. Microbiol. Immunol.*, 158:39–61 (1992); Berkner et al, *Bio Techniques*, 6:616–629 (1988); Gorziglia et al, *J. Virol.*, 66:4407–4412 (1992); Quantin et al, *Proc. Natl. Acad. Sci. USA*, 89:2581–2584 (1992); Rosenfeld et al, *Cell*, 68:143–155 (1992); Wilkinson et al, *Nucl. Acids Res.*, 20:2233–2239 (1992); Stratford-Perricaudet et al, *Hum. Gene Ther.*, 1:241–256 (1990)), vaccinia virus (Mackett et al, *Biotechnology*, 24:495–499 (1992)), adeno-associated virus (Muzyczka, *Curr. Top. Microbiol. Immunol.*, 158:91–123 (1992); Ohi et al, *Gene*, 89:279–282 (1990)), herpes viruses including HSV and EBV (Margolskee, *Curr. Top. Microbiol. Immunol.*, 158:67–90 (1992); Johnson et al, *J. Virol.*, 66:2952–2965 (1992); Fink et al, *Hum. Gene Ther.*, 3:11–19 (1992); Breakfield et al, *Mol. Neurobiol.*, 1:337–371 (1987;) Fresse et al, *Biochem. Pharmacol.*, 40:2189–2199 (1990)), and retroviruses of avian (Brandyopadhyay et al, *Mol. Cell Biol.*, 4:749–754 (1984); Petropouplos et al, *J. Virol.*, 66:3391–3397 (1992)), murine (Miller, *Curr. Top. Microbiol. Immunol.*, 158:1–24 (1992); Miller et al, *Mol. Cell Biol.*, 5:431–437 (1985); Sorge et al, *Mol. Cell*

*Biol.*, 4:1730–1737 (1984); Mann et al, *J. Virol.*, 54:401–407 (1985)), and human origin (Page et al, *J. Virol.*, 64:5370–5276 (1990); Buchschalcher et al, *J. Virol.*, 66:2731–2739 (1992)). Most human gene therapy protocols have been based on disabled murine retroviruses.

Nonviral gene transfer methods known in the art include chemical techniques such as calcium phosphate coprecipitation (Graham et al, *Virology*, 52:456–467 (1973); Pellicer et al, *Science*, 209:1414–1422 (1980)), mechanical techniques, for example microinjection (Anderson et al, *Proc. Natl. Acad. Sci. USA*, 77:5399–5403 (1980); Gordon et al, *Proc. Natl. Acad. Sci. USA*, 77:7380–7384 (1980); Brinster et al, *Cell*, 27:223–231 (1981); Constantini et al, *Nature*, 294:92–94 (1981)), membrane fusion-mediated transfer via liposomes (Felgner et al, *Proc. Natl. Acad. Sci. USA*, 84:7413–7417 (1987); Wang et al, *Biochemistry*, 28:9508–9514 (1989); Kaneda et al, *J. Biol. Chem.*, 264: 12126–12129 (1989); Stewart et al, *Hum. Gene Ther.*, 3:267–275 (1992); Nabel et al, *Science*, 249:1285–1288 (1990); Lim et al, *Circulation*, 83:2007–2011 (1992)), and direct DNA uptake and receptor-mediated DNA transfer (Wolff et al, *Science*, 247:1465–1468 (1990); Wu et al, *BioTechniques*, 11:474–485 (1991); Zenke et al, *Proc. Natl. Acad. Sci. USA*, 87:3655–3659 (1990); Wu et al, *J. Biol. Chem.*, 264:16985–16987 (1989); Wolff et al, *BioTechniques*, 11:474–485 (1991); Wagner et al, 1990; Wagner et al, *Proc. Natl. Acad. Sci. USA*, 88:4255–4259 (1991); Cotten et al, *Proc. Natl. Acad. Sci. USA*, 87:4033–4037 (1990); Curiel et al, *Proc. Natl. Acad. Sci USA*, 88:8850–8854 (1991); Curiel et al, *Hum. Gene Ther.*, 3:147–154 (1991)).

In an approach which combines biological and physical gene transfer methods, plasmid DNA of any size is combined with a polylysine-conjugated antibody specific to the adenovirus hexon protein, and the resulting complex is bound to an adenovirus vector. The trimolecular complex is then used to infect cells. The adenovirus vector permits efficient binding, internalization, and degradation of the endosome before the coupled DNA is damaged.

Liposome/DNA complexes have been shown to be capable of mediating direct in vivo gene transfer. While in standard liposome preparations the gene transfer process is non-specific, localized in vivo uptake and expression have been reported in tumor deposits, for example, following direct in situ administration (Nabel, *Hum. Gene Ther.*, 3:399–410 (1992)).

Transgenic Animals

This invention further relates to nonhuman transgenic animals capable of expressing an exogenous or non-naturally occurring variant Zmax7A, Zmax7B, Zmax8A, Zmax8B, Zmax20, Zmax61A, Zmax61B, or Zmax113 gene. Such a transgenic animal can also have one or more endogenous genes inactivated or can, instead of expressing an exogenous variant gene, have one or more endogenous analogs inactivated. Any nonhuman animal can be used; however typical animals are rodents, such as mice, rats, or guinea pigs.

Animals for testing therapeutic agents can be selected after treatment of germline cells or zygotes. Thus, expression of an exogenous Zmax7A, Zmax7B, Zmax8A, Zmax8B, Zmax20, Zmax61A, Zmax61B, or Zmax113 gene or a variant can be achieved by operably linking the gene to a promoter and optionally an enhancer, and then microinjecting the construct into a zygote. See, e.g., Hogan, et al., *Manipulating the Mouse Embryo, A Laboratory Manual*, Cold Spring Harbor Laboratory, Cold Spring Harbor, N.Y. Such treatments include insertion of the exogenous gene and disrupted homologous genes. Alternatively, the gene(s) of the animals may be disrupted by insertion or deletion mutation of other genetic alterations using conventional techniques, such as those described by, for example, Capecchi, *Science*, 244:1288 (1989); Valancuis et al, *Mol. Cell Biol.*, 11:1402 (1991); Hasty et al, *Nature*, 350:243 (1991); Shinkai et al, *Cell*, 68:855 (1992); Mombaerts et al, *Cell*, 68:869 (1992); Philpott et al, *Science*, 256:1448 (1992); Snouwaert et al, *Science*, 257:1083 (1992); Donehower et al, *Nature*, 356:215 (1992). After test substances have been administered to the animals, modulation of the disorder must be assessed. If the test substance reduces the incidence of the disorder, then the test substance is a candidate therapeutic agent. These animal models provide an extremely important vehicle for potential therapeutic products.

EXEMPLIFICATION

The present invention is described by reference to the following Examples, which are offered by way of illustration and are not intended to limit the invention in any manner. Standard techniques well known in the art or the techniques specifically described below were utilized.

Example 1

The propositus was referred by her physicians to the Creighton Osteoporosis Center for evaluation of what appeared to be unusually dense bones. She was 18 years old and came to medical attention two years previous because of back pain which was precipitated by an auto accident in which the car in which she was riding as a passenger was struck from behind. Her only injury was soft tissue injury to her lower back that was manifested by pain and muscle tenderness. There was no evidence of fracture or subluxation on radiographs. The pain lasted for two years, although she was able to attend school full time. By the time she was seen in the Center, the pain was nearly resolved and she was back to her usual activities as a high school student. Physical exam revealed a normal healthy young woman standing 66 inches and weighing 128 pounds. Radiographs of the entire skeleton revealed dense looking bones with thick cortices. All bones of the skeleton were involved. Most importantly, the shapes of all the bones were entirely normal. The spinal BMC was 94.48 grams in L1-4, and the spinal BMD was 1.667 gm/cm$^2$ in L1-4. BMD was 5.62 standard deviations (SD) above peak skeletal mass for women. These were measured by DXA using a Hologic 2000~. Her mother was then scanned and a lumbar spinal BMC of 58.05 grams and BMD of 1.500 gm/cm$^2$ were found. Her mother's values place her 4.12 SD above peak mass and 4.98 SD above her peers. Her mother was 51 years old, stood 65 inches and weighed 140 pounds. Her mother was in excellent health with no history of musculoskeletal or other symptoms. Her father's lumbar BMC was 75.33 grams and his BMD was 1.118 gm/cm$^2$. These values place him 0.25 SD above peak bone mass for males. He was in good health, stood 72 inches tall, and weighed 187 pounds.

These clinical data suggested that the propositus inherited a trait from her mother which resulted in very high bone mass, but an otherwise normal skeleton, and attention was focused on the maternal kindred. In U.S. Pat. No. 5,691,153, twenty two of these members had measurement of bone mass by DXA. In one case, the maternal grandfather of the propositus, was deceased, however, medical records, antemortem skeletal radiographs and a gall bladder specimen embedded in paraffin for DNA genotyping were obtained.

His radiographs showed obvious extreme density of all of the bones available for examination including the femur and the spine, and he was included among the affected members. In this invention, the pedigree has been expanded to include 37 informative individuals. These additions are a significant improvement over the original kinship (Johnson et al, *Am. J. Hum. Genet.*, 60:1326–1332 (1997)) because, among the fourteen individuals added since the original study, two individuals harbor key crossovers. X-linkage is ruled out by the presence of male to male transmission from individual 12 to 14 and 15.

Example 2

The present invention describes DNA sequences derived from 5 BAC clones from the HBM gene region, as evident in Table 3 below, which is an assembly of these clones. Clone b200e21-h (ATCC No. 980812; FIGS. 3 & 4) was deposited at the American Type Culture Collection (ATCC), 12301 Parklawn Drive, Rockville, Md. 20852, U.S.A., on Dec. 30, 1997. Clone 576i10-h (ATCC No. 980720; FIG. 5), clone b180d17-h (ATCC No. 980209), clone b442p6-h (ATCC No. 980728), clone b160d8-h (ATCC No. 980304) were deposited at the American Type Culture Collection (ATCC), 12301 Parklawn Drive, Rockville, Md. 20852, U.S.A., on Oct. 2, 1998. These sequences are unique reagents that can be used by one skilled in the art to identify DNA probes for the Zmax7A, Zmax7B, Zmax8A, Zmax8B, Zmax20, Zmax61A, Zmax61B, and Zmax113 genes, PCR primers to amplify Zmax7A, Zmax 7b, Zmax 8, Zmax 20, Zmax 61 and Zmax 113 genes, nucleotide polymorphisms in Zmax7A, Zmax7B, Zmax8A, Zmax8B, Zmax20, Zmax61A, Zmax61 B, and Zmax113 genes, or regulatory elements of the Zmax7A, Zmax7B, Zmax8A, Zmax8B, Zmax20, Zmax61A, Zmax61B, and Zmax113 genes.

TABLE 3

| BAC | ATCC No. | Contig | Length (bp) | SEQ ID No. |
|---|---|---|---|---|
| b576i10-h | 980720 | Contig197G | 80409 | 17 |
| b200e21-h | 980812 | Contig2 | 52156 | 18 |
| b200e21-h | 980812 | Contig3 | 73065 | 19 |
| b180d17-h | 980209 | Contig11 | 33308 | 20 |
| b442p6-h | 980728 | Contig297G | 17866 | 21 |
| b442p6-h | 980728 | Contig298G | 19223 | 22 |
| b160d8-h | 980304 | Contig4 | 17705 | 23 |
| b160d8-h | 980304 | Contig5 | 45063 | 26 |
| b442p6 | 980728 | Contig299 | 28002 | 24 |
| b442p6 | 980728 | Contig300 | 132205 | 25 |
| b473o3 | 980305 | Contig90D | 33485 | 27 |

The disclosure of each of the patents, patent applications and publications cited in the specification is hereby incorporated by reference herein in its entirety.

Although the invention has been set forth in detail, one skilled in the art will recognize that numerous changes and modifications can be made, and that such changes and modifications may be made without departing from the spirit and scope of the invention.

SEQUENCE LISTING (58 sequences)

SEQ ID NO: 1 - DNA, 4970 bp, Homo sapiens
ggcctgcttgatacgtccgcctttttgggcgcttcgctgatggtgtcggtgagcgcgtttcccgcctgagcgcaactagcggcgggtcgtgggcacctccagataagaaaacaagctctagagagatgtggtgacttgctcaaatagtgacagaacttcctcggccatatggaggggtcatataatacccttgtgtcttcagtttgaggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaaggtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacagattgtggatttcttaaagaagaagcatgattttgtagaccttattataaagcacataggaacttctgctatcatggatttgttgctcaggctcctgacgtgtatcgaacctccacagcccaggcaagatgtgctgaattggttaaatgaggagaaaattatccagaggcttgtggaaatagttcatccatcgcaagaagaagatcgacattcaaatgcatcacaatcactttgtgaaattgttcgcctgagcagagaccagatgttacaaattcagaacagtacagagcccgaccccctgcttgccactctagaaaagcaagaaattatagagcagcttctatcaaatattttccacaaggagaaaaatgagtcagccatagtcagtgcaatccagatattgctgactttacttgagacacgacgaccaacatttgaaggccatatagagatctgcccaccaggcatgagccattcagcttgttcagtaaacaagagtgttctagaagccatcagaggaagacttggatcttttcatgaactcctgctggagccacccaagaaaagtgtgatgaagaccacatggggtgtgctggatcctcctgtggggaatacccggttgaatgtcattaggttgatatccagcctgcttcaaaccaataccagcagtataaatggggaccttatggagctgaatagcattggagtcatattgaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatcttttccaaaaatgtcaattaatagaacgaatacttgaagcctgggaaatgaatgagaagaaacaggctgagggaggaagacggcatggttacatgggacacctaacgaggatagctaactgtatcgtgcacagcactgacaagggccccaacagtgcattagtgcagcagcttatcaaagatcttcccgacgaagtcagggaacgatgggagacgttctgcacaagctccttaggagaaactaacaagaggaacacggtagatctagttacaacctgccatattcattcatccagtgatgatgaaattgactttaaagaaacgggtttctcacaggattcttctttgcagcaagccttttctgattatcagatgcaacaaatgacgtccaattttattgaccagtttggcttcaacgatgagaagtttgcagatcaagatgacattggcaatgtttcttttgatcgagtatcagacatcaactttactctcaatacaaatgaaagtggaaatattgccttgtttgaagcatgttgtaaggaaagaatacaacagtttgatgatggtggctctgatgaggaagatatatgggaggaaaagcacatcgcattcacaccagaatcccaaagacgatccagctcggggagtacagacagtgaggaaagtacagactctgaagaagaagatggagcaaagcaagacttgtttgaacccagcagtgccaacacggaggataaaatggaggtggacctgagtgaaccacccaactggtcagctaactttgatgtcccaatggaaacaacccacggtgctccattggattctgtgggatctgatgtctggagcacagaggagccgatgccaactaaagagacgggctgggcttctttttcagagttcacgtcttccctgagcacaaaagattctttaaggagtaattctccagtggaaatggaaaccagcactgaacccatggaccctctgactcccagtgcggctgccctggcagtgcagccagaagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaagtgaggaagggaaactgtctacctctcaagatgctgcttgtaaagacgcagaggagtgtcccgagactgcagaggcgaagtgcgcggcgcccaggcctcccagcagcagtcccgagcagaggactggccaaccaagcgcaccaggtgacacttcagtgaatggccctgtatgacgggtgacgtctgctgctgctgactgaggactgcagaccgccaccactcaggggctctggaggggtcagctggagcccaccaagctgtcactgctgcactcactctgcaagggatcaggaccagcaacctttatattctagattctaagacattgtacagagaaattcagaagtgtaaaaatattgcacattgacaaataccaagaatttttgcgtatgtttatattgtattgttctaaataatgggtagcctgtgaaataagatcttgccacccatgtaataatagtagtaatactatagttaaaatggctgtaagaatagttttataaaagtgaatacacagatctattgtatttgaaacataactttgacaattattagtgtgaccaaagtattaggcggttttcatacatttttcaccttgtacaaaattatgaattcatttttcctccaggccgacaaggagttgtagaatgaaaatgccctctaagtgttattttggttgttctaacttacaaaagtgattttgaataagaaatatttggtgttctttttataaccagtttttgattggtaattgttttctgtattgtttaaaacggatcaaaaatgtaagtctattggtagagattaagtaaagtatttattgctacatcatagttgataaattgatgttatcgtaaagccatatgttctgttcaagtcttgtttgcttgaaatgattattcctacaagtgaaacactagactatttggagtgtatatggcttgtgttttgggattttttttttttttttttggcttttgtttttgtttgtttttttgtttcttttggtagttcatctgccttttaacccattcaccaaaatttaccttgttaacaagcatcaccaatgaacatttcagagcaatctgcatatttaacagacctaaaataaatcctattaggcaagtcagttgaaaatgctcgtgctgctaatggaattagagtgcgttcattttacaggctagtattttaaaagtagaaatcaaaatctggcaccgaagcatgctaattgtttactgtaccttgtgaggttttcactcataaatttaaaccagtgtatttttttagaactggtttgtgtatatatatagtgattatggatactaattcaatgtaatttataattttctatgtcaatacaaaaatacatcacagccttctcaaacagctcaagcaatatattgtatattgccatatcgtctggtgaaagggttaaattacttcacctcttgcacttttagatgcaaatcagtttttcatttctgtaatagaaaattattcacgtatttttacatcatttgtttttcctgaccagtatttaaaaccaaaaggatattctgaaaaatggccaacaatttttttagaagtagcatcccaagcagcgtgcctaaacattacattgcatatggaaataaaagaatcaaacgtctaatgccttattttttctgatttcctttttcattttaagtggtgtggagattccagcactcccaggacagtggagtcagcagtaagccctgggacaggtggcaagggtgggtcccttgacctttgcacgcctcctcaggaaccccctttcccgggtgagcccctctctgaagagactgtccttgggcctcctctggaagcagcacccccagaggacagggctcctcctgcttgcctcagggctgcctgacttgaatggcgttggacctcggggattactggtagataatatgctctggtctcgcctggtggtgagttttgccagccatggccagggtttggctccactggtggcacacgtggcctccgtggtatggacctggtggcttctccatcccactgtggcctctgtggtatggacctggtggcttctccatcctacccaaggtaacagtgtcttgcttcatcccactgactgctgggagagagcctctgggacttttctttggggcatcattttgttttgtctttcgtagcagggaaaggatatgacaatggggaggacagttcttttggaggttggaggggccaagccaaggacaggagcaagtgtgccctcattttgtttctacttttaatttctgtgtgttggccatactgaattatgagactaacagatgtctacaatacaatacctgtattcaaaataacaaaaataaagcctgattctttgtttctagaa

SEQ ID NO: 2 - DNA, 5295 bp, Homo sapiens
aggcctgcttgatacgtccgcctttttgggcgcttcgctgatggtgtcggtgagcgcgtttcccgcctgagcgcaactagcggcgggtcgtgggcacctccagataagaaaacaagctcagagagatgtggtgacttgctcaaatagtgacagaacttcctcggccatatggaggggtcatataatacccttgtgtcttcagtttgaggtacctcccataattttaaggggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaagaccagcatgttttggaaatttgatcttcactcatcatcccacatagacacacttctagaaagagaagatgtaacactgaaggagttaatggatgaggaagatgttttacaggaatgtaaagctcagaaccgcaaacttatagagtttctgttaaaagcagaatgtctcgaagatttagtctcattcattatagaagaaccacctcaagacatggatgaaaagatcagatacaagtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacagattgtggatttcttaaagaagaagcatgattttgtagaccttattataaagcacataggaacttctgctatcatggatttgttgctcaggctcctgacgtgtatcgaacctccacagcccaggcaagatgtgctgaattggttaaatgaggagaaaattatccagaggcttgtggaaatagttcatccatcgcaagaagaagatcgacattcaaatgcatcacaatcactttgtgaaattgttcgcctgagcagagaccagatgttacaaattcagaacagtacagagcccgaccccctgcttgccactctagaaaagcaagaaattatagagcagcttctatcaaatattttccacaaggagaaaaatgagtcagccatagtcagtgcaatccagatattgctgactttacttgagacacgacgaccaacatttgaaggccatatagagatctgcccaccaggcatgagccattcagcttgttcagtaaacaagagtgttctagaagccatcagaggaagacttggatcttttcatgaactcctgctggagccacccaagaaaagtgtgatgaagaccacatggggtgtgctggatcctcctgtggggaatacccggttgaatgtcattaggttgatatccagcctgcttcaaaccaataccagcagtataaatggggaccttatggagctgaatagcattggagtcatattgaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatcttttccaaaaatgtcaattaatagaacgaatacttgaagcctgggaaatgaatgagaagaaacaggctgagggaggaagacggcatggttacatgggacacctaacgaggatagctaactgtatcgtgcacagcactgacaagggccccaacagtgcattagtgcagcagcttatcaaagatcttcccgacgaagtcagggaacgatgggagacgttctgcacaagctccttaggagaaactaacaagaggaacacggtagatctagccttttctgattatcagatgcaacaaatgacgtccaattttattgaccagtttggcttcaacgatgagaagtttgcagatcaagatgacattggcaatgtttcttttgatcgagtatcagacatcaactttactctcaatacaaatgaaagtggaaatattgccttgtttgaagcatgttgtaaggaaagaatacaacagtttgatgatggtggctctgatgaggaagatatatgggaggaaaagcacatcgcattcacaccagaatcccaaagacgatccagctcggggagtacagacagtgaggaaagtacagactctgaagaagaagatggagcaaagcaagacttgtttgaacccagcagtgccaacacggaggataaaatggaggtggacctgagtgaaccacccaactggtcagctaactttgatgtcccaatggaaacaacccacggtgctccattggattctgtgggatctgatgtctggagcacagaggagccgatgccaactaaagagacgggctgggcttctttttcagagttcacgtcttccctgagcacaaaagattctttaaggagtaattctccagtggaaatggaaaccagcactgaacccatggaccctctgactcccagtgcggctgccctggcagtgcagccagaagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaaggttctttgacaccttcaccgagtctgcagttttgcttacgtgcagtcgtggacatattattcccccaaattcctcatttctaggagtattctgaaactcttgtacatttctttttctgttttgcacactgggcttcagagtgttgaaatcctatcgtgaggaagggaaactgtctacctctcaagatgctgcttgtaaagacgcagaggagtgtcccgagactgcagaggcgaagtgcgcggcgcccaggcctcccagcagcagtcccgagcagaggactggccaaccaagcgcaccaggtgacacttcagtgaatggccctgtatgacgggtgacgtctgctgctgctgactgaggactgcagaccgccaccactcaggggctctggaggggtcagctggagcccaccaagctgtcactgctgcactcactctgcaagggatcaggaccagcaacctttatattctagattctaagacattgtacagagaaattcagaagtgtaaaaatattgcacattgacaaataccaagaatttttgcgtatgtttatattgtattgttctaaataatgggtagcctgtgaaataagatcttgccacccatgtaataatagtagtaatactatagttaaaatggctgtaagaatagttttataaaagtgaatacacagatctattgtatttgaaacataactttgacaattattagtgtgaccaaagtattaggcggttttcatacatttttcaccttgtacaaaattatgaattcatttttcctccaggccgacaaggagttgtagaatgaaaatgccctctaagtgttattttggttgttctaacttacaaaagtgattttgaataagaaatatttggtgttctttttataaccagtttttgattggtaattgttttctgtattgtttaaaacggatcaaaaatgtaagtctattggtagagattaagtaaagtatttattgctacatcatagttgataaattgatgttatcgtaaagccatatgttctgttcaagtcttgtttgcttgaaatgattattcctacaagtgaaacactagactatttggagtgtatatggcttgtgttttgggattttttttttttttttttggcttttgtttttgtttgtttttttgtttcttttggtagttcatctgccttttaacccattcaccaaaatttaccttgttaacaagcatcaccaatgaacatttcagagcaatctgcatatttaacagacctaaaataaatcctattaggcaagtcagttgaaaatgctcgtgctgctaatggaattagagtgcgttcattttacaggctagtattttaaaagtagaaatcaaaatctggcaccgaagcatgctaattgtttactgtaccttgtgaggttttcactcataaatttaaaccagtgtatttttttagaactggtttgtgtatatatatagtgattatggatactaattcaatgtaatttataattttctatgtcaatacaaaaatacatcacagccttctcaaacagctcaagcaatatattgtatattgccatatcgtctggtgaaagggttaaattacttcacctcttgcacttttagatgcaaatcagtttttcatttctgtaatagaaaattattcacgtatttttacatcatttgtttttcctgaccagtatttaaaaccaaaaggatattctgaaaaatggccaacaatttttttagaagtagcatcccaagcagcgtgcctaaacattacattgcatatggaaataaaagaatcaaacgtctaatgccttattttttctgatttcctttttcattttaagtggtgtggagattccagcactcccaggacagtggagtcagcagtaagccctgggacaggtggcaagggtgggtcccttgacctttgcacgcctcctcaggaaccccctttcccgggtgagcccctctctgaagagactgtccttgggcctcctctggaagcagcacccccagaggacagggctcctcctgcttgcctcagggctgcctgacttgaatggcgttggacctcggggattactggtagataatatgctctggtctcgcctggtggtgagttttgccagccatggccagggtttggctccactggtggcacacgtggcctccgtggtatggacctggtggcttctccatcccactgtggcctctgtggtatggacctggtggcttctccatcctacccaaggtaacagtgtcttgcttcatcccactgactgctgggagagagcctctgggacttttctttggggcatcattttgttttgtctttcgtagcagggaaaggatatgacaatggggaggacagttcttttggaggttggaggggccaagccaaggacaggagcaagtgtgccctcattttgtttctacttttaatttctgtgtgttggccatactgaattatgagactaacagatgtctacaatacaatacctgtattcaaaataacaaaaataaagcctgattctttgtttctagaaa

SEQ ID NO: 3 - DNA, 3433 bp, Homo sapiens
ggggcgatgaggtgaggacgcccgggaaccggaggcggcaccgcgcggcgcacggacctgggacgcggagtcctgaagccggcggacggttttcgtacgggcggccgtgcgcgaggcgaggagagaacattgaaagtattctctaagctatttgaagagagtgactaaatgcacctgggtcaggctgtctgtgggtatgaagtggttgggagaatccaagaacatggtggtgaatggcaggagaaatggaggcaagttgtctaatgaccatcagcagaatcaatcaaaattacagcacacggggaaggacaccctgaaggctggcaaaaatgcagtcgagaggaggtcgaacagatgtaatggtaactcgggatttgaaggacagagtcgctatgtaccatcctctggaatgtccgccaaggaactctgtgaaaatgatgacctagcaaccagtttggttcttgatccctatttaggttttcaaacacacaaaatgaatactagcgcctttccttcgaggagctcaaggcatttttcaaaatctgacagtttttctcacaacaaccctgtgagatttaggcctattaaaggaaggcaggaagaactaaaggaagtaattgaacgttttaagaaagatgaacacttggagaaagccttcaaatgtttgacttcaggcgaatgggcacggcactattttctcaacaagaataaaatgcaggagaaattattcaaagaacatgtatttatttatttgcgaatgtttgcaactgacagtggatttgaaatattgccatgtaatagatactcatcagaacaaaatggagccaaaatagttgcaacaaaagagtggaaacgaaatgacaaaatagaattactggtgggttgtattgccgaactttcagaaattgaggagaacatgctacttagacatggagaaaacgacttcagtgtcatgtactccacaaggaaaaactgtgctcaactctggctgggtcctgctgcgtttataaaccatgattgcagacctaattgtaagtttgtgtcaactggtcgagatacagcatgtgtgaaggctctaagagacattgaacctggagaagaaatttcttgttattatggagatgggttctttggagaaaataatgagttctgcgagtgttacacttgcgaaagacggggcactggtgcttttaaatccagagtgggactgcctgcgcctgctcctgttatcaatagcaaatatggactcagagaaacagataaacgtttaaataggcttaaaaagttaggtgacagcagcaaaaattcagacagtcaatctgtcagctctaacactgatgcagataccactcaggaaaaaaacaatgcaacttctaaccgaaaatcttcagttggcgtaaaaaagaatagcaagagcagaacgttaacgaggcaatctatgtcaagaattccagcttcttccaactctacctcatctaagctaactcatataaataattccagggtaccaaagaaactgaagaagcctgcaaagcctttactttcaaagataaaattgagaaatcattgcaagcggctggagcaaaagaatgcttcaagaaaactcgaaatgggaaacttagtactgaaagagcctaaagtagttctgtataaaaatttgcccattaaaaaagataaggagccagagggaccagcccaagccgcagttgccagcgggtgcttgactagacacgcggcgagagaacacagacagaatcctgtgagaggtgctcattcgcagggggagagctcgccctgcacctacataactcggcggtcagtgaggacaagaacaaatctgaaggaggcctctgacatcaagcttgaaccaaatacgttgaatggctataaaagcagtgtgacggaaccttgccccgacagtggtgaacagctgcagccagctcctgtgctgcaggaggaagaactggctcatgagactgcacaaaaaggggaggcaaagtgtcataagagtgacacaggcatgtccaaaaagaagtcacgacaaggaaaacttgtgaaacagtttgcaaaaatagaggaatctactccagtgcacgattctcctggaaaagacgacgcggtaccagatttgatgggtccccattctgaccagggtgagcacagtggcactgtgggcgtgcctgtgagctacacagactgtgctccttcacccgtcggttgttcagttgtgacatcagatagcttcaaaacaaaagacagctttagaactgcaaaaagtaaaaagaagaggcgaatcacaaggtatgatgcacagttaatcctagaaaataactctgggattcccaaattgactcttcgtaggcgtcatgatagcagcagcaaaacaaatgaccaagagaatgatggaatgaactcttccaaaataagcatcaagttaagcaaagaccatgacaacgataacaatctctatgtagcaaagcttaataatggatttaactcaggatcaggcagtagttctacaaaattaaaaatccagctaaaacgagatgaggaaaatagggggtcttatacagaggggcttcatgaaaatggggtgtgctgcagtgatcctctttctctcttggagtctcgaatggaggtggatgactatagtcagtatgaggaagaaagtacagatgattcctcctcttctgagggcgatgaagaggaggatgactatgatgatgactttgaagacgattttattcctcttcctccagctaagcgcttgaggttaatagttggaaaagactctatagatattgacatttcttcaaggagaagagaagatcagtctttaaggcttaatgcctaagctcttggtcttaacttgacctgggataactactttaaagaaataaaaaattccagtcaattattcctcaactgaaagtttagtggcagcacttctattgtcccttcacttatcagcatactattgtagaaagtgtacagcatactgactcaattcttaagtctgatttgtgcaaatttttatcgtactttttaaatagccttcttacgtgcaattctgagttagaggtaaagccctgttgtaaaataaaggctcaagcaaaattgtacagtgatagcaactttccacacaggacgttgaaaacagtaatgtggctacacagtttttttaactgtaagagcatcagctggctctttaatatatgactaaacaataatttaaaacaaatcatagtagcagcatattaagggtttctagtatgctaatatcaccagcaatgatctttggctttttgatttatttgctagatgtttcccccttggagttttgtcagtttcacactgtttgctggcccaggtgtactgtttgtggcctttgttaatatcgcaaaccattggttgggagtcagattggtttctt

SEQ ID NO: 4 - DNA, 5704 bp, Homo sapiens
ggggcgatgaggtgaggacgcccgggaaccggaggcggcaccgcgcggcgcacggacctgggacgcggagtcctgaagccggcggacggttttcgtacgggcggccgtgcgcgaggcgaggagagaacattgaaagtattctctaagctatttgaagagagtgactaaatgcacctgggtcaggctgtctgtgggtatgaagtggttgggagaatccaagaacatggtggtgaatggcaggagaaatggaggcaagttgtctaatgaccatcagcagaatcaatcaaaattacagcacacggggaaggacaccctgaaggctggcaaaaatgcagtcgagaggaggtcgaacagatgtaatggtaactcgggatttgaaggacagagtcgctatgtaccatcctctggaatgtccgccaaggaactctgtgaaaatgatgacctagcaaccagtttggttcttgatccctatttaggttttcaaacacacaaaatgaatactagcgcctttccttcgaggagctcaaggcatttttcaaaatctgacagtttttctcacaacaaccctgtgagatttaggcctattaaaggaaggcaggaagaactaaaggaagtaattgaacgttttaagaaagatgaacacttggagaaagccttcaaatgtttgacttcaggcgaatgggcacggcactattttctcaacaagaataaaatgcaggagaaattattcaaagaacatgtatttatttatttgcgaatgtttgcaactgacagtggatttgaaatattgccatgtaatagatactcatcagaacaaaatggagccaaaatagttgcaacaaaagagtggaaacgaaatgacaaaatagaattactggtgggttgtattgccgaactttcagaaattgaggagaacatgctacttagacatggagaaaacgacttcagtgtcatgtactccacaaggaaaaactgtgctcaactctggctgggtcctgctgcgtttataaaccatgattgcagacctaattgtaagtttgtgtcaactggtcgagatacagcatgtgtgaaggctctaagagacattgaacctggagaagaaatttcttgttattatggagatgggttctttggagaaaataatgagttctgcgagtgttacacttgcgaaagacggggcactggtgcttttaaatccagagtgggactgcctgcgcctgctcctgttatcaatagcaaatatggactcagagaaacagataaacgtttaaataggcttaaaaagttaggtgacagcagcaaaaattcagacagtcaatctgtcagctctaacactgatgcagataccactcaggaaaaaaacaatgcaacttctaaccgaaaatcttcagttggcgtaaaaaagaatagcaagagcagaacgttaacgaggcaatctatgtcaagaattccagcttcttccaactctacctcatctaagctaactcatataaataattccagggtaccaaagaaactgaagaagcctgcaaagcctttactttcaaagataaaattgagaaatcattgcaagcggctggagcaaaagaatgcttcaagaaaactcgaaatgggaaacttagtactgaaagagcctaaagtagttctgtataaaaatttgcccattaaaaaagataaggagccagagggaccagcccaagccgcagttgccagcgggtgcttgactagacacgcggcgagagaacacagacagaatcctgtgagaggtgctcattcgcagggggagagctcgccctgcacctacataactcggcggtcagtgaggacaagaacaaatctgaaggaggcctctgacatcaagcttgaaccaaatacgttgaatggctataaaagcagtgtgacggaaccttgccccgacagtggtgaacagctgcagccagctcctgtgctgcaggaggaagaactggctcatgagactgcacaaaaaggggaggcaaagtgtcataagagtgacacaggcatgtccaaaaagaagtcacgacaaggaaaacttgtgaaacagtttgcaaaaatagaggaatctactccagtgcacgattctcctggaaaagacgacgcggtaccagatttgatgggtccccattctgaccagggtgagcacagtggcactgtgggcgtgcctgtgagctacacagactgtgctccttcacccgtcggttgttcagttgtgacatcagatagcttcaaaacaaaagacagctttagaactgcaaaaagtaaaaagaagaggcgaatcacaaggtatgatgcacagttaatcctagaaaataactctgggattcccaaattgactcttcgtaggcgtcatgatagcagcagcaaaacaaatgaccaagagaatgatggaatgaactcttccaaaataagcatcaagttaagcaaagaccatgacaacgataacaatctctatgtagcaaagcttaataatggatttaactcaggatcaggcagtagttctacaaaattaaaaatccagctaaaacgagatgaggaaaatagggggtcttatacagaggggcttcatgaaaatggggtgtgctgcagtgatcctctttctctcttggagtctcgaatggaggtggatgactatagtcagtatgaggaagaaagtacagatgattcctcctcttctgagggcgatgaagaggaggatgactatgatgatgactttgaagacgattttattcctcttcctccagctaagcgcttgaggttaatagttggaaaagactctatagatattgacatttcttcaaggagaagagaagatcagtctttaaggcttaatgcctaagctcttggtcttaacttgacctgggataactactttaaagaaataaaaaattccagtcaattattcctcaactgaaagtttagtggcagcacttctattgtcccttcacttatcagcatactattgtagaaagtgtacagcatactgactcaattcttaagtctgatttgtgcaaatttttatcgtactttttaaatagccttcttacgtgcaattctgagttagaggtaaagccctgttgtaaaataaaggctcaagcaaaattgtacagtgatagcaactttccacacaggacgttgaaaacagtaatgtggctacacagtttttttaactgtaagagcatcagctggctctttaatatatgactaaacaataatttaaaacaaatcatagtagcagcatattaagggtttctagtatgctaatatcaccagcaatgatctttggctttttgatttatttgctagatgtttcccccttggagttttgtcagtttcacactgtttgctggcccaggtgtactgtttgtggcctttgttaatatcgcaaaccattggttgggagtcagattggtttcttttaaaaaaaaaaaaaaaacgacatacgtgacagctcacttttcagttcatgatatgtacgagggtagcagtgtgtgggatgaggttcgatacagcgtatttattgcttgtcatgtaaattaaaaaccttgtatttaactcttttcaatccttttagataaaattgttctttgcaagaatgattggtgcttattttttcaaaaatttgctgtgaacaacgtgatgacaacaagcaacatttatctaatgaactacagctatcttaatttggttcttcaagttttctgttgcacttgtaaaatgctacaaggaatattaaaaaaatctattcactttaacttataatagtttatgaaataaaaacatgagtcacagcttttgttctgtggtaacctataaaaaaagtttgtctttgagattcaatgtaaagaactgaaaacaatgtatatgttgtaaatatttgtgtgttgtgagaaatttttgtcataagaaattaaaagaacttaccaggaaggtttttaagtttagaaatattcatgccaataaaataggaaattataaatatatagttttaagcactgcatcagtgggagttcttggcttatgttagtttatgttagtttattatgaaaacatcaaagatttttttgactatattatcagttaaacaaaaaggagtcagatttaatttgttttttgaagcactttgagaaattaattttaattaacttaatgagcaaatttttattactactttatgttcaataccaggttcttttcatttctctggattattttgcaaatcattggacagagaatttgggaatataaatctgtaacaggtgtttgacaccagtaggtctctttatttctgggaaatgtgtacctgtactttctgatatacagtgttcctaagtaaaaatcaattcaggggatttgtatagtgtctataggaaagtagcccatgtcttgaaatatgaaaaggaatctgaaggtcatgaaaagtccagtggagaaaatctcaatgcttactgttactactaattgattcctactagtttccaggtttggggggatattgtttcaatgacgctccttaagactgttgattgcccataggttccaaatagaaattaagactcatgaacatttttagaaagtagattgttttctcctggttctctaaggaactacttctgcagtcttacatagtctcatccttgtttgttgtggtgcagtcgaactcctcaggcgtttggaaagcatgtggtagaccttcttccacacccacccatacccccgttcactgcgtctggaggtcttcaacagtgaagtagggcagcccacacagcctctcaggagcacctgtccgaggcacccggagcactttgcagagcacgtccagccctcatggggtccctgcatagaaatgtgaacccctgccactgaggaagatgaaggtagaccctgtgtctggaggtgctggagggcagcgggtcacctcttgtattcccaccttagtttggggtgttttgaagaggttcagagactaaatcttaaaccttatttgaataccaacgatagctattttgggaatttcgatcttaaaaagtgacaaaacacatttcccattttcatttttcagctgaattttagtaacttatttttgatgttttaattttatcatggcctcctctttggaggccaaccttcccatgggtctcaaagcagtgacatttggtagtaaatcactgcctctcaggagtcggtatgcacaagcactcagcagccactgttgatgccttctagggaaacctaatttccgttggtaaaggtaggggcctcggaactgttccggatctgctgtagaacttcaccgtgtggaatggtgacagccacacaccgttgaccagtttagaagaggttgcattcaataaaactcttagcttgagcttatgcaatgattggttaagattttggcattgtaagaattaggagatgatcatagaaatatatgtaaagtattcaattttcaatcattttcaaattactgttataaattgtttttgctgagttgtaatacttttgagatacaatgtattccttgtactgaaagaatgaaaaaggactttttcagcatttgaggtaagttctttaacgtttcattaaaaacattttttacaaatattttgtacatgcacttgcagtattgaggttaatcattttaataaattcggaaattaaaacaatttggccggtgttcactgtatct

SEQ ID NO: 5 - DNA, 688 bp, Homo sapiens
gcgggaagatggcggcggccatggcagcatcttccctgacggtcaccttagggcggctggcgtccgcgtgcagccacagcatcctgagaccttcggggcccggagcagcctccctttggtctgcttctcgaaggttcaattcacagagcacttcatatctaccaggatatgttcctaaaacatccctgagttcaccaccttggccagaagttgttctgccagacccagttgaggagaccagacaccatgcagaggtcgtgaagaaggtgaatgagatgatcgtcacggggcagtatggcaggctctttgccgtggtgcactttgccagccgccagtggaaggtgacctctgaagacctgatcttaattggaaatgaactagaccttgcgtgtggagagagaattcgactggagaaggtcctgctggttggggcagacaacttcacgctgcttggcaagccactcctcggaaaggatcttgttcgagtagaagccacagtcattgaaaagacagaatcatggccaagaatcattatgagattcaggaaaaggaaaaacttcaagaagaaaagaatcgtcacgaccccgcagactgtcctccggataaacagcattgagattgctccgtgtttgttgtgattaccgagttaatacttacaaaaggataaaaataaactcctgcttcccaa

SEQ ID NO: 6 - DNA, 5272 bp, Homo sapiens
tgcgcagtgaagctgggcgccttcggggcttgagcttctgagggtcgggtccagcgcgtgggctgctggatggcggaaccccaggcggagtcggagcccctgctgggcggggcccgcggcggtggcggcgactggccggcggggctgaccacttaccgcagcatccaagtcggccctggtgccgcggccaggtgggacctctgcattgatcaggctgtggtcttcatcgaagatgctattcagtaccgctccatcaaccaccgggtggatgccagctcgatgtggctttaccgacggtattactcgaacgtatgccaacggactttgagcttcaccatcttcttgatcctgtttttggcttttatcgagaccccatcctcactcaccagcacggcggacgtgcgctaccgcgctgccccctgggagccgccctgcggcctgaccgagagtgtcgaggtgctctgcctgctggtctttgcggccgacctctctgtgaagggttacctgttcgggtgggcccatttccagaaaaacctttggctgctgggctacctcgtggtgctggtggtgtctctggtggactggaccgtgtccctgagtctcgtgtgtcatgagcccctgcggatccgccggcttctccgtcccttcttcctgctgcagaactcctctatgatgaagaagaccttgaaatgcatccgctggtcgctgccggaaatggccagcgtcgggctgctgctggccatccacctgtgcctcttcaccatgttcggaatgctgctgttcgctggtgggaagcaggatgatgggcaggacagggagaggctgacctacttccagaacctgcctgagtctctgacttccctcctggtgctgctgaccacggccaacaaccccgatgtgatgattcctgcgtattccaagaaccgggcctatgccatcttcttcatagtcttcactgtgataggaagcctgtttctgatgaacctgctgacagccatcatctacagtcagttccggggctacctgatgaaatctctccagacctcgctgtttcggaggcggctgggaacccgggctgcctttgaagtcctatcctccatggtgggggagggaggagccttccctcaggcagttggggtgaagccccagaacttgctgcaggtgcttcagaaggtccagctggacagctcccacagacaggccatgatggagaaggtgcgttcctatggcagtgttctgctctcagctgaggagtttcagaagctcttcaacgagcttgacagaagtgtggttaaagagcacccgccgaggcccgagtaccagtctccgtttctgcagagcgcccagttcctcttcggccactactactttgactacctggggaacctcatcgccctggcaaacctggtgtccatttgcgtgttcctggtgctggatgcagatgtgctgcctgctgagcgtgatgacttcatcctggggattctcaactgcgtcttcattgtgtactacctgttggagatgctgctcaaggtctttgccctgggcctgcgagggtacctgtcctaccccagcaacgtgtttgacgggctcctcaccgttgtcctgctggaggccggagatggtgggcctgctgtcgctgtgggacatgacccgcatgctgaacatgctcatcgtgttccgcttcctgcgtatcatccccagcatgaagccgatggccgtggtggccagtaccgtcctgggcctggtgcagaacatgcgtgcgtttggcgggatcctggtggtggtctactacgtatttgccatcattgggatcaacttgtttagaggcgtcattgtggctcttcctggaaacagcagcctggcccctgccaatggctcggcgccctgtgggagcttcgagcagctggagtactgggccaacaacttcgatgactttgcggctgccctggtcactctgtggaacttgatggtggtgaacaactggcaggtgtttctggatgcatatcggcgctactcaggcccgtggtccaagatctattttgtattgtggtggctggtgtcgtctgtcatctgggtcaacctgtttctggccctgattctggagaacttccttcacaagtgggacccccgcagccacctgcagccccttgctgggaccccagaggccacctaccagatgactgtggagctcctgttcagggatattctggaggagcccggggaggatgagctcacagagaggctgagccagcacccgcacctgtggctgtgcaggtgacgtccgggctgccgtcccagcaggggcggcaggagagagaggctggcctacacaggtgcccatcatggaagaggcggccatgctgtggccagccaggcaggaagagacctttcctctgacggaccactaagctggggacaggaaccaagtcctttgcgtgtggcccaacaaccatctacagaacagctgctggtgcttcagggaggcgccgtgccctccgctttcttttatagctgcttcagtgagaattccctcgtcgactccacagggacctttcagacaaaaatgcaagaagcagcggcctcccctgtcccctgcagcttccgtggtgcctttgctgccggcagcccttggggaccacaggcctgaccagggcctgcacaggttaaccgtcagacttccggggcattcaggtggggatgctggtggtttgacatggagagaaccttgactgtgttttattatttcatggcttgtatgagtgtgactgggtgtgtttctttagggttctgattgccagttattttcatcagtaagtcttgcaaagaatgggattgtcattcttcacttcagcacagttctagtcctgcttctctggagtagggttgttgagtaaggttgcttgggttgtgcattgcacaagggcacatggctgtgaggtgtatcctggcggggggctgtctacctgcagtgaggggcaccttttctgttttgctcaaaggcatgtataagccaatgggtgaccttatttcctgtgtcttcaggtgtgtggcagggggcctggggtggggaggtggggcgagcgagcagtgtgtggaaagccttgttgtcacctgaagcacgccaggtccagattgaccaatggttttctcacttcaggggccaacccacgccccctttctgctgaggtttgggtgccatctagtggtgggatgggacttggttgactacatttaaggtaaggtggacccagcaactcccagaaacaactccggggacaccactccccatcacactccacaccgagcctggtgcccggtctgtgcccgagctcagcgggaccaggaagggatgggccctgccagggttgcccctgcactgtgcattctcgcctgggaggcacaagttctttcatctgcttttccttcagaggtgctgagcccacgccatagcccctgtgggatggtgggggagggggcgacccgaacaacagtgcagtcggtatcgagattggggagaggagcgagtccaaggagaaagtcatgagtttctttttactcgtgttgaataataacaataacaataacaataacaatatggaaaccaccgcaaacttggagaaaagttgtaagcacagtaaagagaagcttccttctgagtcagttgagtggttgccgttctggccctgcaccctctgtgctttgggacggcgtccaacccgcattcatgtcaggagtgagtcgcacgtggctttgtggtcatggcgacttaatccgcctggacggtggctccgtctccctgggcttagacgaccttggcacttctggagataagcccatggctcccaggttgtgttcatgtgacgtttccttgtggtaggttctgggtctgcgttttgtctaggagtgtcacaggatggacactgcctcctggcaggggctgcccaatgcagttagcctcctgctggtgttctctcttgttgcttggtgaaggtggccctggtcagcttctccactgcccagtgaacgacccctttgtaatgaatgagtggggaggtagtgtgaagcgatgccaatatcccatccctgtcaaactgcctttactttttccttccttccttgctcccacctgtgtggatcctggtcccttcttgtattcagggctgtggtctgttatgacatttactctcaggctcaggtcctgcttgtttggcccgtgggagccccttcttctgccttttgtgttttttttgttatgtacctacagttctttagctgtttctttactttctggtgcaaaaagatgttcaagccttattttatacttgcctgcccctttctctttcatttattggagtgagctgcagctctaagaagacctgttcttttgaatggagagtagcatcaggaaccaggatgtgggtgcgaggcgtgctcctggctgttgcagattgctgcacccgggagctcttagtggacagagctagaggatatgtgcacgtacttccatctctctctctgtctcatctattcacagctgggaatgatactaatacctccgattttagcccagcaccacagggtacgttccagtttttctctctttccatagctgtaaggccctttctgggaatggttctcattctccttaatctattattgggtcagttttcctgcatgtccccagcctcccatcactgccacccactccccacagagatgccctgctcatccgactggggctttgactcccacactgtgtacccctcttgtgtggacgccctgctgccaaaaccttcagcaaacagctttccaaatggaagttgtcactgtcagggcctttacaatcagcaacagcaaaatctacatgctgctgagggtcctgcctcattaagatgcaataaatatgtaagtacataaaaacagcaatagaagaaacgtaatgcttttttctcaaatatgatgtctacatagaaaagccaaaattattaagaatagtaagaattcacccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccagcctgggcgacagagcgagactccgtctcaaaaaaaa

SEQ ID NO: 7 - DNA, 5322 bp, Homo sapiens
tgcgcagtgaagctgggcgccttcggggcttgagcttctgagggtcgggtccagcgcgtgggctgctggatggcggaaccccaggcggagtcggagcccctgctgggcggggcccgcggcggtggcggcgactggccggcggggctgaccacttaccgcagcatccaagtcggccctggtgccgcggccaggtgggacctctgcattgatcaggctgtggtcttcatcgaagatgctattcagtaccgctccatcaaccaccgggtggatgccagctcgatgtggctttaccgacggtattactcgaacgtatgccaacggactttgagcttcaccatcttcttgatcctgtttttggcttttatcgagaccccatcctcactcaccagcacggcggacgtgcgctaccgcgctgccccctgggagccgccctgcggcctgaccgagagtgtcgaggtgctctgcctgctggtctttgcggccgacctctctgtgaagggttacctgttcgggtgggcccatttccagaaaaacctttggctgctgggctacctcgtggtgctggtggtgtctctggtggactggaccgtgtccctgagtctcgtgtgtcatgagcccctgcggatccgccggcttctccgtcccttcttcctgctgcagaactcctctatgatgaagaagaccttgaaatgcatccgctggtcgctgccggaaatggccagcgtcgggctgctgctggccatccacctgtgcctcttcaccatgttcggaatgctgctgttcgctggtgggaagcaggatgatgggcaggacagggagaggctgacctacttccagaacctgcctgagtctctgacttccctcctggtgctgctgaccacggccaacaaccccgatgtgatgattcctgcgtattccaagaaccgggcctatgccatcttcttcatagtcttcactgtgataggaagcctgtttctgatgaacctgctgacagccatcatctacagtcagttccggggctacctgatgaaatctctccagacctcgctgtttcggaggcggctgggaacccgggctgcctttgaagtcctatcctccatggtgggggagggaggagccttccctcaggcagttggggtgaagccccagaacttgctgcaggtgcttcagaaggtccagctggacagctcccacagacaggccatgatggagaaggtgcgttcctatggcagtgttctgctctcagctgaggagtttcagaagctcttcaacgagcttgacagaagtgtggttaaagagcacccgccgaggcccgagtaccagtctccgtttctgcagagcgcccagttcctcttcggccactactactttgactacctggggaacctcatcgccctggcaaacctggtgtccatttgcgtgttcctggtgctggatgcagatgtgctgcctgctgagcgtgatgacttcatcctggggattctcaactgcgtcttcattgtgtactacctgttggagatgctgctcaaggtctttgccctgggcctgcgagggtacctgtcctaccccagcaacgtgtttgacgggctcctcaccgttgtcctgctggttttggagatctcaactctggctgtgtaccgattgccacacccaggctggaggccggagatggtgggcctgctgtcgctgtgggacatgacccgcatgctgaacatgctcatcgtgttccgcttcctgcgtatcatccccagcatgaagccgatggccgtggtggccagtaccgtcctgggcctggtgcagaacatgcgtgcgtttggcgggatcctggtggtggtctactacgtatttgccatcattgggatcaacttgtttagaggcgtcattgtggctcttcctggaaacagcagcctggcccctgccaatggctcggcgccctgtgggagcttcgagcagctggagtactgggccaacaacttcgatgactttgcggctgccctggtcactctgtggaacttgatggtggtgaacaactggcaggtgtttctggatgcatatcggcgctactcaggcccgtggtccaagatctattttgtattgtggtggctggtgtcgtctgtcatctgggtcaacctgtttctggccctgattctggagaacttccttcacaagtgggacccccgcagccacctgcagccccttgctgggaccccagaggccacctaccagatgactgtggagctcctgttcagggatattctggaggagcccggggaggatgagctcacagagaggctgagccagcacccgcacctgtggctgtgcaggtgacgtccgggctgccgtcccagcaggggcggcaggagagagaggctggcctacacaggtgcccatcatggaagaggcggccatgctgtggccagccaggcaggaagagacctttcctctgacggaccactaagctggggacaggaaccaagtcctttgcgtgtggcccaacaaccatctacagaacagctgctggtgcttcagggaggcgccgtgccctccgctttcttttatagctgcttcagtgagaattccctcgtcgactccacagggacctttcagacaaaaatgcaagaagcagcggcctcccctgtcccctgcagcttccgtggtgcctttgctgccggcagcccttggggaccacaggcctgaccagggcctgcacaggttaaccgtcagacttccggggcattcaggtggggatgctggtggtttgacatggagagaaccttgactgtgttttattatttcatggcttgtatgagtgtgactgggtgtgtttctttagggttctgattgccagttattttcatcagtaagtcttgcaaagaatgggattgtcattcttcacttcagcacagttctagtcctgcttctctggagtagggttgttgagtaaggttgcttgggttgtgcattgcacaagggcacatggctgtgaggtgtatcctggcggggggctgtctacctgcagtgaggggcaccttttctgttttgctcaaaggcatgtataagccaatgggtgaccttatttcctgtgtcttcaggtgtgtggcagggggcctggggtggggaggtggggcgagcgagcagtgtgtggaaagccttgttgtcacctgaagcacgccaggtccagattgaccaatggttttctcacttcaggggccaacccacgccccctttctgctgaggtttgggtgccatctagtggtgggatgggacttggttgactacatttaaggtaaggtggacccagcaactcccagaaacaactccggggacaccactccccatcacactccacaccgagcctggtgcccggtctgtgcccgagctcagcgggaccaggaagggatgggccctgccagggttgcccctgcactgtgcattctcgcctgggaggcacaagttctttcatctgcttttccttcagaggtgctgagcccacgccatagcccctgtgggatggtgggggagggggcgacccgaacaacagtgcagtcggtatcgagattggggagaggagcgagtccaaggagaaagtcatgagtttctttttactcgtgttgaataataacaataacaataacaataacaatatggaaaccaccgcaaacttggagaaaagttgtaagcacagtaaagagaagcttccttctgagtcagttgagtggttgccgttctggccctgcaccctctgtgctttgggacggcgtccaacccgcattcatgtcaggagtgagtcgcacgtggctttgtggtcatggcgacttaatccgcctggacggtggctccgtctccctgggcttagacgaccttggcacttctggagataagcccatggctcccaggttgtgttcatgtgacgtttccttgtggtaggttctgggtctgcgttttgtctaggagtgtcacaggatggacactgcctcctggcaggggctgcccaatgcagttagcctcctgctggtgttctctcttgttgcttggtgaaggtggccctggtcagcttctccactgcccagtgaacgacccctttgtaatgaatgagtggggaggtagtgtgaagcgatgccaatatcccatccctgtcaaactgcctttactttttccttccttccttgctcccacctgtgtggatcctggtcccttcttgtattcagggctgtggtctgttatgacatttactctcaggctcaggtcctgcttgtttggcccgtgggagccccttcttctgccttttgtgttttttttgttatgtacctacagttctttagctgtttctttactttctggtgcaaaaagatgttcaagccttattttatacttgcctgcccctttctctttcatttattggagtgagctgcagctctaagaagacctgttcttttgaatggagagtagcatcaggaaccaggatgtgggtgcgaggcgtgctcctggctgttgcagattgctgcacccgggagctcttagtggacagagctagaggatatgtgcacgtacttccatctctctctctgtctcatctattcacagctgggaatgatactaatacctccgattttagcccagcaccacagggtacgttccagtttttctctctttccatagctgtaaggccctttctgggaatggttctcattctccttaatctattattgggtcagttttcctgcatgtccccagcctcccatcactgccacccactccccacagagatgccctgctcatccgactggggctttgactcccacactgtgtacccctcttgtgtggacgccctgctgccaaaaccttcagcaaacagctttccaaatggaagttgtcactgtcagggcctttacaatcagcaacagcaaaatctacatgctgctgagggtcctgcctcattaagatgcaataaatatgtaagtacataaaaacagcaatagaagaaacgtaatgcttttttctcaaatatgatgtctacatagaaaagccaaaattattaagaatagtaagaattcacccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccagcctgggcgacagagcgagactccgtctcaaaaaaaa

SEQ ID NO: 8 - DNA, 1932 bp, Homo sapiens
gcccggagctgcctgggttgcgctgccggccacgtccccgcgccgggcctcaggctccttcctactgtccgagggccaccaggccgccgggggcctgctgcgcccggatgcgtctgttactagagtggagagtctaccttcgtctcacatgtgccacaaaggatggcatggcccgggagtgccccaccacgtggctttcaccccctgcaaagccagacttcgcccagcgacacagtgtcaagcccacagctctccaaggaggaagatggtccaggctgggagcatccccttagcagcagcctctgatcccttggccaagcaggagggaaccattagcagcctgaggagctggctggctgggagcctcggggaccgcccagccttgctcccagctcacccacaagatgtggacagctcttgtgctcatttggattttctccttgtccttatctgaaagccatgcggcatccaacgatccacgcaactttgtccctaacaaaatgtggaagggattagtcaagaggaatgcatctgtggaaacagttgataataaaacgtctgaggatgtaaccatggcagcagcttctcctgtcacattgaccaaagggacttcggcagcccacctcaactctatggaagtcacaacagaggacacaagcaggacagatgtgagtgaaccagcaacttcaggagttgcagctgatggtgtgacctccattgctcccacggctgtggcctccagtacgactgcggcctccattacgactgcggcctccagtatgactgtggcctccagtgctcccacgactgcagcctccagtacaactgtggcctccattgctcccacgactgcagcctccagtatgactgcggcctccagcactcccatgacacttgcactccccgcgcccacgtccacttccacagggcggaccccgtccactaccgccactgggcatccatctctcagcacagccctcgcacaagtgccaaagagcagcgcgttgccaagaacagcaaccctggccacattggccacacgtgctcagactgtagcgaccacagcaaacacaagcagccccatgagcactcgtccaagtccttccaagcacatgcccagtgacaccgcggcaagccctgtaccccctatgcgtccccaagcacaaggtcccattagccaggtgtcagtggaccagcctgtggttaacacaacaaataaatccacacccatgccctcaaacacaaccccagagcccgcccccacccccacagtggtgaccaccaccaaggcacaagccagggagccaactgccagcccagtgccagtacctcacaccagcccaatccctgagatggaggccatgtcccccacgacacagccaagccccatgccatatacccagagggccgctgggccaggcacatcccaggcaccggagcaggtagagactgaagccacaccaggtactgattccactgggccaacacccaggagctcagggggcactaagatgccagccacggactcgtgccagcccagcacccaaggccagtacatggtggtcaccactgagcccctcacccaggccgtggtagacaaaactctccttctggtggtgctgttactcggggtgacccttttcatcacagtcttggttttgtttgccctgcaggcctatgagagctacaagaagaaggactacacccaggtggactacttaatcaacgggatgtatgcggactcagaaatgtgaggggggcgggggcctggcgggaggcctggccccttcctcgtcctttccttttgcctttgagaccaaaccaagtgcttccaaattcttttggtgcaattgaggagatatgccagatgcttaaacacatttaattgctgtcagattaattccatgatcactaaagagttgctgctttttt

SEQ ID NO: 9 - protein, 782 aa, Homo sapiens
MNDRLGEDESLLMKLYSFLLNDSPLNPLLASFFSKVLSILISRKPEQIVDFLKKKHDFVDLIIKHIGTSAIMDLLLRLLTCIEPPQPRQDVLNWLNEEKIIQRLVEIVHPSQEEDRHSNASQSLCEIVRLSRDQMLQIQNSTEPDPLLATLEKQEIIEQLLSNIFHKEKNESAIVSAIQILLTLLETRRPTFEGHIEICPPGMSHSACSVNKSVLEAIRGRLGSFHELLLEPPKKSVMKTTWGVLDPPVGNTRLNVIRLISSLLQTNTSSINGDLMELNSIGVILNMFFKYTWNNFLHTQVEICIALILASPFENTENATITDQDSTGDNLLLKHLFQKCQLIERILEAWEMNEKKQAEGGRRHGYMGHLTRIANCIVHSTDKGPNSALVQQLIKDLPDEVRERWETFCTSSLGETNKRNTVDLVTTCHIHSSSDDEIDFKETGFSQDSSLQQAFSDYQMQQMTSNFIDQFGFNDEKFADQDDIGNVSFDRVSDINFTLNTNESGNIALFEACCKERIQQFDDGGSDEEDIWEEKHIAFTPESQRRSSSGSTDSEESTDSEEEDGAKQDLFEPSSANTEDKMEVDLSEPPNWSANFDVPMETTHGAPLDSVGSDVWSTEEPMPTKETGWASFSEFTSSLSTKDSLRSNSPVEMETSTEPMDPLTPSAAALAVQPEAAGSVAMEASSDGEEDAESTDKVTETVMNGGMKETLSLTVDAKTETAVFKSEEGKLSTSQDAACKDAEECPETAEAKCAAPRPPSSSPEQRTGQPSAPGDTSVNGPV

SEQ ID NO: 10 - protein, 818 aa, Homo sapiens
MFWKFDLHSSSHIDTLLEREDVTLKELMDEEDVLQECKAQNRKLIEFLLKAECLEDLVSFIIEEPPQDMDEKIRYKYPNISCELLTSDVSQMNDRLGEDESLLMKLYSFLLNDSPLNPLLASFFSKVLSILISRKPEQIVDFLKKKHDFVDLIIKHIGTSAIMDLLLRLLTCIEPPQPRQDVLNWLNEEKIIQRLVEIVHPSQEEDRHSNASQSLCEIVRLSRDQMLQIQNSTEPDPLLATLEKQEIIEQLLSNIFHKEKNESAIVSAIQILLTLLETRRPTFEGHIEICPPGMSHSACSVNKSVLEAIRGRLGSFHELLLEPPKKSVMKTTWGVLDPPVGNTRLNVIRLISSLLQTNTSSINGDLMELNSIGVILNMFFKYTWNNFLHTQVEICIALILASPFENTENATITDQDSTGDNLLLKHLFQKCQLIERILEAWEMNEKKQAEGGRRHGYMGHLTRIANCIVHSTDKGPNSALVQQLIKDLPDEVRERWETFCTSSLGETNKRNTVDLAFSDYQMQQMTSNFIDQFGFNDEKFADQDDIGNVSFDRVSDINFTLNTNESGNIALFEACCKERIQQFDDGGSDEEDIWEEKHIAFTPESQRRSSSGSTDSEESTDSEEEDGAKQDLFEPSSANTEDKMEVDLSEPPNWSANFDVPMETTHGAPLDSVGSDVWSTEEPMPTKETGWASFSEFTSSLSTKDSLRSNSPVEMETSTEPMDPLTPSAAALAVQPEAAGSVAMEASSDGEEDAESTDKVTETVMNGGMKETLSLTVDAKTETAVFKRFFDTFTESAVLLTCSRGHIIPPNSSFLGVF

SEQ ID NO: 11 - protein, 885 aa, Homo sapiens
MKWLGESKNMVVNGRRNGGKLSNDHQQNQSKLQHTGKDTLKAGKNAVERRSNRCNGNSGFEGQSRYVPSSGMSAKELCENDDLATSLVLDPYLGFQTHKMNTSAFPSRSSRHFSKSDSFSHNNPVRFRPIKGRQEELKEVIERFKKDEHLEKAFKCLTSGEWARHYFLNKNKMQEKLFKEHVFIYLRMFATDSGFEILPCNRYSSEQNGAKIVATKEWKRNDKIELLVGCIAELSEIEENMLLRHGENDFSVMYSTRKNCAQLWLGPAAFINHDCRPNCKFVSTGRDTACVKALRDIEPGEEISCYYGDGFFGENNEFCECYTCERRGTGAFKSRVGLPAPAPVINSKYGLRETDKRLNRLKKLGDSSKNSDSQSVSSNTDADTTQEKNNATSNRKSSVGVKKNSKSRTLTRQSMSRIPASSNSTSSKLTHINNSRVPKKLKKPAKPLLSKIKLRNHCKRLEQKNASRKLEMGNLVLKEPKVVLYKNLPIKKDKEPEGPAQAAVASGCLTRHAAREHRQNPVRGAHSQGESSPCTYITRRSVRTRTNLKEASDIKLEPNTLNGYKSSVTEPCPDSGEQLQPAPVLQEEELAHETAQKGEAKCHKSDTGMSKKKSRQGKLVKQFAKIEESTPVHDSPGKDDAVPDLMGPHSDQGEHSGTVGVPVSYTDCAPSPVGCSVVTSDSFKTKDSFRTAKSKKKRRITRYDAQLILENNSGIPKLTLRRRHDSSSKTNDQENDGMNSSKISIKLSKDHDNDNNLYVAKLNNGFNSGSGSSSTKLKIQLKRDEENRGSYTEGLHENGVCCSDPLSLLESRMEVDDYSQYEEESTDDSSSSEGDEEEDDYDDDFEDDFIPLPPAKRLRLIVGKDSIDIDISSRRREDQSLRLNA

SEQ ID NO: 12 - protein, 885 aa, Homo sapiens; identical to SEQ ID NO: 11

SEQ ID NO: 13 - protein, 209 aa, Homo sapiens [sequence omitted]

SEQ ID NO: 14 - protein, 584 aa, Homo sapiens [sequence omitted]

SEQ ID NO: 15 - protein, 752 aa, Homo sapiens [sequence omitted]

SEQ ID NO: 16 - protein, 417 aa, Homo sapiens
MWKGLVKRNASVETVDNKTSEDVTMAAASPVTLTKGTSAAHLNSMEVTTEDTSRTDVSEPATSGVAADGVTSIAPTAVASSTTAASITTAASSMTVASSAPTTAASSTTVASIAPTTAASSMTAASSTPMTLALPAPTSTSTGRTPSTTATGHPSLSTALAQVPKSSALPRTATLATLATRAQTVATTANTSSPMSTRPSPSKHMPSDTAASPVPPMRPQAQGPISQVSVDQPVVNTTNKSTPMPSNTTPEPAPTPTVVTTTKAQAREPTASPVPVPHTSPIPEMEAMSPTTQPSPMPYTQRAAGPGTSQAPEQVETEATPGTDSTGPTPRSSGGTKMPATDSCQPSTQGQYMVVTTEPLTQAVVDKTLLLVVLLLGVTLFITVLVLFALQAYESYKKKDYTQVDYLINGMYADSEM

SEQ ID NO: 17 - DNA, 80409 bp, Homo sapiens
  unsure (6717), (18514), (21728): Identity of nucleotide sequences at the above locations are unknown.
tagcgccgatgtcttcaagccccgtggtgaacacctgtttggggaacagtatcttcagttctaggtttcttcatttctctccttgagccttccaagcacatttattttagtctttatcagactattctacaaaattaatttcatctgcagtggattctaattattgactggataactttgtgaacattagaattctgggcgtgttttggaacatcggtttgcaagctcttccgagctggtatgacttttctttctcttccctgttctcattgtttcaggattgctgcccccctaccgcctcacccctccagctcctggttctttgtcccagccatctcctgtggtactgtgctgtgtctgccttgtggagaccctgaggatgttctggatggagttaccaagcccccgacaggctggtccagttcctggcctcaacaaagtatgtgtccttttgcctcaggagaccagctgctccctaaaggctgcagcccccagcagagtttggcctgtttttctgcctgtttcacaagagagtgagcccccctggctccagctgcccacctgcacgaagctctgttaatagctgggacctccgtagcacctgggcccccagcctggtgctgggcctgggcttcagcttctctccaactcccatctactccacatctggtcctgggagatgtttactttccttctgagcccagcagtgtcttcttagttttctctttgtcgaggccatggatcattcctccgggccgtgtcgaatgtgctgtgtttatcttgtctgtggagatgaagggccgaagtgtgaatgcacagcgccaccttaaccagacgttcaaatcattctttttaaaagctgcataaaactccgtggcatccagtgctccccaggcggtgggtgtttttgtttcatggtttgatgggttttttttgcccgatgaataacactgctgtgcaccagggtgcatacagccttaaatacctgtatgcagctttcaaagctgttctataatgtctcactttattctttccacatttgcagctttttatctttgtatcttatcttttttctgagtttcttttggtatattttgttgttctttttccagtttcttaaaatgaagagctgttactcaaaaaaaaaaaaaaaattctagaacaaggcaggcattgaggtgagccacgtcttctggcccccactctgccgtgtgctgtctactttgtgaaaaagtgtgcttcttcttaatgcttccgagagagttggtagctttcatttcatggcaaagattatcaaggagtgtttctacatttccaagaggatttcggtcactttgaaaaagagaagatcaattttactgtggtatgattttatttatttatcatttacttatttttagggtcagggtctcgctctgttgcccaggctggagtgcagtggcatgatcacgactcactgcagcctccgactcctgggcacaagcaatcctcccacctcagcctcccaagtagctgggactacaggcatgagccaccatgcctggctgtggtatgatttacatctgagaaaactaacccataggttgtaggcaggataatggccctcacccagatgtctacatcctaatttcccactccttttacatctgtaagattttgctttgtgttctaagaccaggtttattaggtgtacacacatttagaactgttacatggtccaggtggactggccctcttaatgctgatgaaatgtctgtattttactctggtaactcttcttccctcgcagcctcctttggtgtcagtagttaatagtgccacatcagctctgctcatttagcatcttcgtggcgtatgatttcagtccccttcagcccttctgtgactttccatgtgcatgtctcttataagtagcatacgatcgaatataatattttactcaatgttacaatatttgtttttaattggagcattttgtctatatatatatatattttgagatggagtctcactctcacccaggctggagtgcagtggtgcaatatgggctcactgcaacctctgcctcctgggttcaagcaattctcctgtctcagcctcctgagtatctgggattacaggtgcccctgccaccacgcctgactaattttgtatttttagtagagatggggttttgccatgttggccaggctggtcttgaactcctgacctcaggtgatctgcccgcctcagcctcccaaaatgctgggatgacaggtgtgagccaccatgcccggcctccatttatatctaatgaagtgaattcagttacacagatgtgggtctggacccgccgcccactgtctctgtgttctttgccctccttcccctcattttttgccctctttgatgtgccgtggaaattcgcggacggcgttggcagtgcgaagcttcgttggggagaagggtcgggcagggatgctgcaatccacaactcagatccgagaaaggctccccgcccagccaggagtgcagggtgaaggctggccagcagaacagccccgtgctggcctgagatggctgggcttagcacttggggggagcgccccataagagagtgaccttggtcctgctgccttgctcagtccctggctgtgctgagctgggaaggcaaaccctgggggagctggcagctgggggctgcccctgaccacatgcctcgcagctgctgggcagagcatcctctgtctaaggaggtctgattctaccctgtgtctgccattatccgcccttgcactggccggatccccttttccacacatgtgggaaaccacccttccagggcccctctctctgtgtatttagaagagggaaattaatggaaaaaatgacagccccatagccaactgcgttcatctgggaacacagtggtccctcttgtccccgcctctactttctgttctaaattgccctggcgctcagctgtctcctgttggcatcaggtgcatctggtggctggacccaagccctatgttcctgaagactgtgagcccctgtgagtccctgctaaccatgcccttttggggtcagagttgctattcagatccatttccggtcataatcggaagagggggtgccaagaagcacctgcccacgtcgggtgtctgagtcccacatgtattcctctctgccgcctgctctcaggtgacagcagcccccatgtccccctgctgctcagggccagccacccccactaagagggtggctcctcttacggcttgctggctgggccaaaaggagcctgcagtaccctggtggaagctacagcttgtagttctgtcctctggcaagcaaacacctcctttggaaccagaaccgctaaccttgcagagccaagactggggagatggaaaacacaaacaggggtgaccaggagtgatgctgagtgggccgccctgctcccacccctcagctcccagacctatgtgtgctttctgctgagaacacagtgccatatgaaggcctctgactcaatgtccccatgccatccgggatgacggggcctgtagttacagggcattgcttcagctctccgtgtgggaggccactccaacacccagccagtccagcagcttccgaacaatgagacgcaatgagtagatcctagggacacagaccctttcccacatctccttcactgcaaagtggcttccctgatcagaagtgatgttgtgagcccttctacgccgatgaacaggacattccttaagcgcttggacagtgatgccgactgaggccctggagccaggaaagacaaactcctacctagaagagatgtctatttttgtgcaaaccactggcctttccagaatgaaagaggcccagtgggtccacttgctgtcaagtggctggttggtctcctgtgaacctgggccacactggcagtgggatgctggtctcctgttgctggcaggttggacattcagataagagaaggagccagatggttttgggaggttgcagtccacactgttggcctcatgcctgccctctgtctcagctgtggccgctccgtccatgtgcctgtctttgttgggttggtgtagccactaaggctggctcccatcagtgggttgagtgatcttgtctgcctggtggttcagtgcttcttccatggaagatgcttgggctgcaacaaaatgcagcaggacaaccccccaaaataaaacacctacagccccaccccaacaactgataggcgatgtctgggaagactgtgacccgtagtactcagcctatgaggaaacgggggagagacctgtgcactaggggataaattgcttgttgaaaccgtgctgggtgtgcctactcatcagacacccgagcttacaagaccatcattaagagtcccacttccgctgttctccgggtctcttgagtccatcctttgggtttggacaggcgagtttgtttctcacacctagtcccagtctttgctgtctcatcctcacaagcagcccaccccgaattctctctctcagggtgtactgtctattcggcatctaactttcagaatattctttttcttttgcaataaattactctgttacctctcctctgctgtgtgtctcttgtttaaattattttaaactaagaagatgagaaccaaggtctcacaacagcaacaataggagactcaagatgcagcaattgagacggagtcttgctctgtcacccaggctggagtgaaatgtcggctcactgcaacctccatctcccaggttcaagcgattttcccgcctcagcctcctgagaatctgggattacaggcacacaccaccatgcccagctttttttttttttttttttttttttgtatttttagtagagatgggttttttccatgttggccaggctggtcttgaactcctggcctcaggtgatccatccaccttggcctcccaaagtggtgggattataggcatgagccaccatgcctggcctagcaattgcctttttattctatttgttagagacagggtcttgctctgttgcccaggctggagtgcagttgtgtgatcacagctcagtgcagcctggaaccccagggctcaagtgatccagcttcagccccgggagtagctgggatgacaggtgtgcatcaccactttcatgtgcgtccatgtgaagagaccaccaaacaggctttgtgtgagcaataaagcttttaatcacctgggtgcaggcgggctgagtccaaaaagagtcagtgaagggagatggggtggggccgttttataggatttgggtaggtaaaggaaaattacagtcaaaggggggttgttctctggcgggcaggagtgggggtcacaaggtactcagtgggggaggttttcagccaggatgagccaggagaaggaatttcacaagataatgtcatcagttaaggcaggaacaggccattttcacttcttttgtggtggaatgtcatcagttaaggcggggcagggcatattcacttcttttgtgattcttcagttacttcaggccacctgagcgtatgcgtgcaagtcacaggggatgccatggcttggcttgggctcagaggcctgacattcctgccttcttatattaataagaaaaataaaacaaaatagtgttgaagtgttggggcagcaaaaatttttggggggtggaatggagagagagaatgggcgatgtttctcagggctgctttgagcgggattaggggccgtgtgggaacctagagtgggagagatgaagctgaaggaagattttgtggtaaggggtgatattgtggggttgttagaaggaacatttgtcatttagaattattggtgatggcctggatacagttttgtatgaattgagaaactaaatggaataagagaaggagaaaaacaggtattaaaggtctaagaattgggaggacctaggacatctgattagagtgcctaaggagattcagcatagtcctgtcagcaaagattatttatttacttccagagttaagagtggcagtttggggatagcaccaggagatatcagctgtgatggcttggagaaacagtgtaaaccagcagtgtaaacaagagcagggcatgtatgaatagttgagaacggtgaataggagtatgactagacagaagatagtagggatgacaagttttttgggggcacagtctaagttggtctggtgtctggaatgagactggggcctaataaaaaggagcgtctatacaggagctcaaatgggctgtaccttgtagcattctgaggacaggtctgacttctgagaagggaaagtggtaaaagtattgtccagtcctttttaagttggtggctgagcttggtgagttgtgtttttaaaagaccttcagtctgttctacttttcctgaagacggaggaccgtaagggatataaaggtttcactgaatactaagagcctgaaaaactgcttggctgatttgactaataaaggctggtctgttatcagactgtatagaggtgggaaggctaaactgaggaattatgtctgacagaagggaagaaatgactgcggtggccttctcagaccctgtaggaaaggcctgtacctatccagtgaaagtgtctacctagaccaagaggtattttagttatctgactcggggcatgttgagtaaagctaatttgccagtcctgggtgggggcaaatcctcgaatttgatgtgtanggaagggcctgaataatccctgaggagtagtagaatagcagatggaacactgagaagttatttccttgaggatagatttccatgatggaaagaaaatgagaggttataagaggcgggctagtggcttgtactatagcatagcctgcctttgctggtgtgtggcgattaggcctgatggaactgccatcaataaatcaagtgtgatcggggtgaggaaccggaaagaaggacatatggggaaatggggtgaatgtcaggtggatcagagagatacagtcatgggggtcaggtgcggtatcaggaataatgtgggaagccaaattgaagtctgggccagcaacagtggtaattgtgggacttaacaaagagtgagtacagctgaaggagcccgggagcaggaagtatatgcgtcaggtatgaggaagaaaatagattttggaagttatgagaaatgtagagagtaagttgagcatagtttgtgattttgagggcctctaaaagtattagggcatcagcagccgctgcacggagatatgatgtcttggctaaaacaataaggtcaagttgtttggacagaaaggctacagggtgcggtcctggctcttgtgtaagaattctgaccacactaaccatgcctaggaaggaaaggagttgttttgtaagggattgaggtttgggagattaatcggacatgatcagcagggagagcacgtgtgtttttatgagaattatgctgagataggtaacagatgagaaagaaatttgggcttgactgaagtaatgggggctgtctgtgaagccttgtggcagtacagcccaggtaatttgctgagcctgatgggtgtcagggtcagtctaagtgaaagcgaagagaggctgggatgatgggtgcaaaggaatagtaaagaaagcatgtttgagatccagaacaaaataatggattgtggagggaggaattgaggataggagagtatatgagtttggcaccacggggtggataggcaaaacaatttggttgataaggcatagatcctgaactaacttgtaaggcttgtctggttttaggacaggtaaaacaggggaattataaggagagtttatagctttaaaaggccataccgtagcaggcgagtgataacaggctttaatcctttcaaagcgtgctgtgggatgggatattggcgttgagccgggtaagggtgattaggttttaatgagatggtaagcggtgcatgatcggtctccaaggagggagtagaggtatcttacacttgtgggttaaggtggggggatacaagaggaggacgcaaaggaggctttggattgggaagaagggtggcaatgaggtgtggctgtagcccaggaatagtcagggaagcagataatttagttaaagtgtctcagcctaataagggaactgggcaggtggggataagtaaaaggagtgcttaaaagagtactgtctaatttggcaccagagttggggagttttaagaggtttagaagcctggccgtgaatacccacaacagttatggaggcaagggaaacaagcccttgaaaagaaggtgatgtggagtggatagcctccgtattgattaagaaggggatggacttactttccactgtgagagttatgggaagcttggcgtccctgatggtctagggggcttctgaggcaatcgggcagcgtcagtcttcagccgctaagccaagaagatctgggaagcagtcagccttgggccagacttccaggagctctgggagtggctgccaggtgagttgaacagtccgatttccagtggggtcccgcacagatgggatgcagcttaggaggaattctgggctgtaggcattccttggcctggtggccagatttctggcacttgtagcaagctcctgggggaggaggttctggaggaacgcctggccactgcggtttaggcgttcggaagttcttgtgtgctggagatgtggctggggtttgtctcacagtggaggcaaggaattgcaacctttttctattattgtacaccttgaaggcaaggttaattaaatcctgttgtggggtttgagggccggaatttaatttttggagttttatttaatgttgggagcagattgggtaataaaatatattttgagaataagacagccttttgaccttttagggtctagggctgtaaagcgtctcaggattgctgccaaaggagccatgaactgggctggatttttatatttgatgaaaaagaggctaaacgctatctgatttgggataaagaaaaaggagcattaaccttgactatgcctttagctccagccacctttttaagagtaaattgctgggcaggtgggggagggctagtcacggaatgaaactgtaagctggaccaggtgtgaggaggggaggtgataaaaggattatagggtggaggagcggaggctgaggaagaattgggacctagctcggcctggcgagggagcagcctggggaggaggggagaggtcagatgggtctgtagaaaaggaagattagaaaggctcagcgacacttgggattgggactgaggggacaggtgggagggaaaggaggaagatttgggatgagttgcactgggaacagagactagagagggaccgatgtgtgaaagaatgcctggacatcaggaacctcagaccatttgcccattttacgataagaattatttagatcttgtaggatgaaaaaattgaaagtgtcattttccagctatttggaactactgtcaagtttgtattggggtcaagtggcattgcagaagaaaataagatgcttagattttaggtcaggtgagagctgaagaggttttcagtttttgaggacacaggctaagggagaagaaggaggaatggagggtgtaaagttgcccatagtgaaggaagcaagcccagagaaaagagagtagagacatggagggaaggggttcgggagttcttaccttccagaaaagcaggaaaggggttggggcgtggaaataaggggttggggtgcagagataagaggtcggggtgtggaaataaggcatgtggtgcagagataagaggtcagggcatggaaataagggattggggtgcagagatacgaggttggggtacttgcccctcctctagaaaagcgggacttgccactcagggtgaaggagaaggggttggggtttcttgccccgcagaaaggtggagaatgggtagagacacggagagaaggggttggggtacttgccactaagggcgaaggaccaaggcaggcgtccctgcatggtctgacacctctgaaacctgggtgaataatcaaagaggcacccctgcaatgattaaacaccaagggaaggctgccttccctagtccgtgaccggcgctggagttttgagtccatggataaaacgtgtctcctttctctctaccagaaaatgaaaggaattgaaattaagagaagggagagattgaagagtggaaaggagaaagtggttgagggacagtgagagaggttggagaagagagtaagaagaggccacttacccgatttaaaattggtgagatgttccttgggctggttggtctgaggacctgaggtcgtaggtggatctttctcatggagcaaagaacaggaggacaggggattgatctcccaagggaggtcccccgatctgagtcacggccccaaatttcataggcgtccatgtgaagagaccaccaaacaggctttgtgtgagcaataaagcttttaatcacctgggtgcaggcgggctgagtccaaaaagagagtcagcaaagggagatggggtggggccgttttataggatttgggtaggtaaaggaaaattacagtcaaaggggggttctctggcaggcaaagtgggggtcacaaggtactcagtgggggaggttttgagccaggatgagccaggagaaggaatttcacaagataatgtcatcagttaaggcaggaacaggccattttcacttcttttgtgattcttcagttacttcaggccatctgggcatatgcgtgcaagtcacaggggatgcgatggcttggcttgggctcagaggcctgacaaccacacctggctaattttttaaattttttgtagacatggggtctcgaattcctgggctcaagcagtcctcctgcctcggcctctgaaagtgttgggattacaggcgtgagccccggtgctcagcctgtcttttattttagaaggtgtagtagacagacgttaagggaaccccatgatccctgcttccaggtattcatgtccttgtataatctcccctgttgattgtgggtgggatttgtgtgctacagtctaaatattggtatcccccaaaattcaaatgttgaaggttgcagcccgatacaatagcatgaagaggtggggatttggaaggtgtttaggtcatgaggactccaccctcacaaatggaattggtgcccttataaaagaggtcaaaaggcacccctgccccttctgccccgtgaacacacaggaacgaggctccatcgtggaagcagagggccagccctcaccagacaccagatctgctggcaccttgatcttggacctcacagcccaagaactgcgagaaataaatttctattgtttataaagtactcaggctaaggtattttgttagcagcctgaatagacaagatatcgtaattgcttctaactagtagaatacagcaaatgtgatgagatatcatgcccatgattacattaagatttgggctagaggagaccttagcctcatcaaaggattacattctgtgtgtttgaggccatatttacctgctctagcaaagataccacgtctggtgcaacagcgccaccagggctatgagctagttaagtcggctctaaactctagttaaattcagtgtcatctggcttctgcaggccagaccggagaattaaatggagacgtgataggaaccacccatcctttagatctttaagtgtggccattatttctgccctcctttctgccacccactcactcctctgtaatgcaatatgtttttcaaatgtggtaaatttcacgtgcatccgtgtgaagagactactaaacaggctttgtgtgagcagtaaagcttttaatcacctgggtgcaggcgggctgcgtctgaaaagagagtcagcgaagggagataggggtggggctgttttataggatttgggtaggtaaaggaaaattacagtcaaagggggtttgttctctggcaggcaggagtggggatctcaaggcgctcagtgggggagattttgagtcaggatgagccaggaaaaggactttcacaaggtaatgtcatcacttaaggcaaggaccagccattttcacttctttttggtggaatgtcatcagttaaggcggggcagggcatattcacttcttttgtgattcttcagttacttcaggccacctgggcgtatacgtgcaagtcacaggggatgcgatggcttggcttgggctcagaggcctgacattcctgccttcttatattaacaagaaaaataaaacaaaatagtgttggggcggcaaaaatttttggggggtggaatggagagagagaacgggcgatgtttctcagggctgcttcaagcaggattaggggcggcgtgggaacttagagtgggagagattaagctgaagggagatctcatggtaaggggtgatattgtggggttgttagaagaaacatttgtcgcatagaatgattggtgatggcctggatacggttttggatgaattgagaaactaaacggaagatacaaggtccgaataaaagaaggagaaaaatgggtattaaaggactaagaattgggaggacttaggacatctaattagagagtgcccaagggggttcagcgtaattacttgcttggttggcaagtttttgggctcgatccttgagtttttttatgttgtcatacactaggctagattgatttaggtaaaaacaacacttttcatttaagaatatacagagtcttccttttccagcagtgagtaagtcaaggcctcggtggttttggaggacaactgcagctaaagagtcatcttgggcctggaggactgataaagtttgtgatatgtctgatgctagcagagaagtcattagacaggctacggaaggtcatgacagaggttgaaatgcctgctattctaatactgagagcaatagtgaaggcagaaagtctttttttttgtcatgtcggtgtcatgaggggaacagggagctttttggtgctatttacaaattgaattttgggagtaaggaaaactagtgtgcatgtgcctgtctaattagcaggtaaacacatgtaggtagaggatctacagaggaagaagagaccttgtgcgaggcaaaactggagatgtaaaaaggtgagaaggagtgctgagaggggtgtgttgtacttagactcctagggatccagctggggcggcagctgtcagaggttgtaatggggactgatggggtaactgcgtagaggaggaggttcaattttcatgttgtatgagaaaacgttgagtatctacgagaaacctttcactgttatttttggggctgagtataagtaaacaagaagagggcctgggaggagagtctgatgagcaaggggaaggtagccaaggatggagtgaaatacagggtaagtgtcttcctaagcaataattactgctaacgtttttaagtttgtcagtattgatagagggcttgtctgtaatacagagctggaaggctttaattgtttcagtgatgtgtgtagttgggcttcggagatgaagagtaaaggaacatcgagaaggtgaaagattacctaggggaattccggtaggtctttgccaagagatacataaaggagcggccacaggaatagtagtttgtgttgtaagaggtccaaatatgaggggagtagagttaatataaggagaaatgttttttaaataagtgcggaggagggcggcatcttgctgatgtgaaatgtctggggaagttttgctggacttgtctagaaagtaaatgagttcttcaggagggtaaaggtgagggctgttaaaggaagtttggaggtgtaaggagacaggagatgttgcctagtctgtctgtaaggtggggacagctgtgtaggcactggaagaaagggaaatgcaaagccagcagttgttcactaaggagggattagaggtggctaggagggaatgggtaaggttgatagtgtggtggagatagctggggagaggtaaagggtggcataagaatgagaatgagaataagagtgagtataaaagtaaagaatagaacttcatcagggtggaagtattggagggtgccctgccagcaaagatcatctacttactttaagagggaattaagagtggcagtttggggatagcaccaagggatatcagctgtgatggcttgaagaaacagtgtaaactggcagtgtaaacaagagtagggcatttataagtagttgaaaacggagaataagagtatgactagacagaaaatagtatggatgacaagttttttggggctcggcctaagtggtgggggtaacttctttgttgcaaaaagtagggtaaggacgaacagacctaatacaatgaagggatgtattatgctcataagggttattactgttcttcagaaataggagtgagtttaagggaactaggggagagtacttgcaacttccacgaggaatatgagggattaagctggctgtccgatggacacagctttattctggaatggtgaacctagtggggaagatcctgccagcggacggcagtcagggtactatagatgactaagtagggtccggtccatcgaggttgtaaagtctgaggggtcagatttttaacaagaactgatcgtttaactagggtgtcttcttatggctggggatctggagtaggcaagagatgattacagcttggtgaatttcctgtctagcctgctggaggactggaagatagtcgcctagagggctggtgtctgggatgaggttggggctaagcaagaaagtgcgtctatataaaagttcaaatggactgtaccttgtagcatcttgaggacaggctctaattctgagaagggcaagaggtaaaagtactaactaatctttttgaagttggtggctgagcttggtgaggtgtgtctttaaaagactattagtcctttctacttttcctgaagattgaggactgtaagggatatgaaggttctactgaataccaagagcctgagaaactgcttgggtgatttgactagtaaaggctggtctgctatcagactgtatagaggtgggaaggccaaactgaggaattatgtctgacagaagggaagaaatgactgcggtggccttctcagaccctgtggggaaggcctctacttatctagtgaaagtgtctacctagactaagatattttagttttctgacttgaggcatgtgagtaaagtcaatttgccagtcctgggcgggggcaaatctttgagcttgatgtgtagggaagggaggggtctgaacaatccttgaggggtagtagaatagcagatggaacactgagaagtgatctccttgaggatagatttctatgatggaaaggaaatgagaggttctaagagacgggctagtggcttgtaacttacatggaagaggttatgaaatgacgacagaatagaatgggcttgtgaggctggaaggagatattttccttggtctaagaactatttgccttgtgtgggaagagattgacaggtggaagtttcagcgggggagtaggtgggagtgactgatgtgaaggagaaaaactggccgtgagggacagaagttgcagagctagctgcttgtctagctactttatcagcataagtgttgctgtgagagacagaatttggaaagctagctgcttgtctagctactttatcagcataagtgttgcttagagcaatgggatctgacgccttttgatgcctcttgcagtgaatgactccagcttcctttggaagtaaagcggccttgagtagagtttttattaaagaggcattaatgatggaggacccttgtgtagtgaggaaacctctttcagcccatatgaccgcatggtggtgcagaatatgaaaggcatatttagaatcagtatagatattgacgtgtagtctttttgcaagagtgagggcttcagttaaggcaactagttcggcttgctgagaggtagtggaggcgtgcagagcggtagccttaatgatagatgtggaagatagtatagcatagcctgcctttgctggtgagtggtgattaggcctggtggaactgccatcagtaaactaagtgtgatcagggtgagaaatagggaagaaggcaatgtggggaaatggggtgaacgtcaggtggatcagagagatgcagtcatgagggtcaggtgtggtatctggaataatgtgggaggctggattgaagtctgggccaggaacaatggtaattgtgggacttaacaaagagtgagtacagctgaaggagccagggagcagaaagtatatgtgtcaggtgtgaggaagaaaatagattttggaaatcatgagagctgtagagagtgagttgagcatagtttgtgattttgagggcctctaaaagtattagggctgcagcagccgctgcacagagacatgatggccagcctaaaacagtgaggtcaagttgtttggacaaaaaggctacaggatgcgatcctggtccttgtgtaagaattctgactgcacagcgctgcactgcggctgtgtgtaatgaaaagagtggggatgagtcagggagagcctgggtgggggcagtctctaaagctgtcttcaaggaacagaaagaggagtggggaaaggatttaggatctatggggtcaactagggttttttttgtgagtttatataatggttttgttaggatggcaaaactaggtatctgaaggcgaaagtatccaaccatgcccaggaaggaaaggagttgttgttttgtagaaggggttggggtttgagagatcagtcggacacgatcagcagggagagcacatgtgtttttatgaagaattatgccgaggtaggtaacaggtggggaagaaatttgaactttgaagggggatacctgatatcttttggagaataaatgctgaagaagcagaagtgtgtcttgttgagaagattcaaaggaggggctacaaagaagaagatcatcaatatattgaataaggtgagaagcggaggtgtggaaagaaagtaaatcatgagaaagagcttggctgaagtaatgagggctgtccttgaaaccttgtggcagcacagcccaggtaagccgctgggactgatgggtgtcagggtcagtccaggtgaaagcaaagagaggctgggacgaggggtgcaggggaatagtgaaaagggcatctttaagatcaagaatggaagagtgagttgtggaggaaggtattgaggacaaaagagtgtacgggttgggcagcacagggtggataggcaaaacaatttggttgataaggcacagatcctgaactaatctgtaagacttgtctggtttttggacaggtaaaatgggggaattgtaaggagagtttataggttttagaagcccatgctgtaccaggcgagtgataacaggctttaatccttttaaagcgtgctatgggatgggatattggcgttgagcggggtaagggtggttaggttttaatgggatggtaatgggcatgtgatcggttgccagggaaggagtagagatgtcccatacttgtgggttaaggtggggggatacgagaggaagacgcgaaggagggtttgggttagaagggcggcaatgagatgcggctgtagtccaggaatagtcagggaagcagataatttggttaaaatatctcagcctaataagggaactgggcaggtggggataactaaaaaagagtgcataaaagagtgttgtctaagttggcaccagagtaggggagttttcaggggttttgaagcttggccgtcaatacttacaacagttatgggggcaaaggaaacaggcccttggaaagaaggtaatgtggagtgggtagcccccgtatcgattaaacgggatggacgtaccctccactgtgagagttacctgaagcttggcatccgtgatggtccagggggcttctgaggcgatcaggcagtgtcaatcttcagtcactaagccgagcagatctgggaaggagtcagtcagagagccttgggctagagctttaggggctctaggagtggctgccgggtgagctgggcagtctgccttccagtgggtccctgcacagataggacatggcttggaaggaatcctgggctgcgggcattccttggcccagtggccagatttctggcacttgaagcaagatcgtgatggaggaagtcttgtaggaatgcttgactgctgagcttaggtgtgtgcggcttaggcattctgaagttcttgaatgctggaggtgtggctggtttttttctcacagcagaggcaagtaattgtaacttagaaatgtgttgccgtctggctgcttcctctctattattatacaccttgaaggcgaggtcgattaattcctgttgtggggtttgagggccaaattctaatttttgaagttttttcctaatgtcaggagtggattgggtgataagatgcatattaagaataaggcggccttctggccttcctgggtctagggcggtttancgtctaagggttggctgctaagtgggccatgaacggggctgggtttccgtctttactttgggtagtttctttctttttttttttttttttgaggaatatactttatttatttatttttcattatgattattatactttaagttttagggtacctgtgcacaacgtgcaggtttgttacatatgtatacatgtgccatgctggtgtgctgcacccattaactcgtcatttagcattaggtatatctcccaatgctatccctcccccctcccctcaccccacaacagtccccggtgtgtgatgttccccttcctgtgtccatgtgttctcattgttcaattcccgcctataagtgagaacacgcggtgtttggttttttgtccttgtgatagtttgctgagaatgatggtttccagtttcatccatgtccctacaaaggacgtgaactcatcattttttatggctgcatagtattccatggtgtgtatgtgccacattttcttaatccagtctatggttgttggacattcaggttggttccaagtctttgctgttgtgaatagtgccgcaataaacatacgtgtgcatgtgtctttatagcagcatgatttataatactttgggtatatacccagtaatgggatggcggggtcaaatggtattgctagttctacatccctgaggaatcgccacactgtcttccacaatggttgaactagtttacagtcccaccaacagtgtaaaagtgttcctatttctccacatcctctccagcacctgttgtttcctgactttctaatgatcgccattctaactggtgtgagatgcaatctcattgttgttttgatttgcatttctctgatggccagtgatgatgagcattttttcatgggttttttggctgcataaatgtcgtcttttgagaagtgtctgttcatatcctttgcccacttactttgggtaatttctttaagcttgtcataattaacagctttgtaagctgcctttttaagcccttcaactaggcaggaaatcacgtaatctcgcctagctatacctggggaatttgcctggtagttccattggggatcctctcaggaaactgctctaatgccttcctggaggcctggctcgtgaagccagcggttatcagcgtgagattggacttgagaaaatctctttcccgttcatctggggagagggtagaagtcagggtgacattttagtcactttaggttaaattgtaggacagagttaaatattggaattcctgtatatatttagtggggtctgatgagaaagagcctaaacgctgactgatctgagagaggtctgatagagaaaaaggtaaatgtactttgactatgccttcagctccagccacctctctaagaggaaattgttgggcaggtggggaagaactagtcacagaactaaactgtaagccggacagggtgtgaggaggggaggtggtagaaggattacagggtggaggagaggaggctgaggaggaattgggacttgtcttggcaacgagcagcctggggaggaggggaaaagtcagatgggtctgtagaaaaggaagactggaaagactcagcaacgcttggggttgggactaaggggacaggcgggagggaaagaaggaggatttgggaggaatcgcattgggaacagagactagggagggaacgaagcgtgaaaaatgcctggacgtaaggcacctcagaccatttgcctatttttcgacaaaaattatttaggtcttgtaggatggagaaatcgaaagtgccgttttctggccatttagagccattgtcaagtttgtattggggccaagcggtgttgcagaagaagataaggcatttaggttttaggtcaggtgtgagttgaagaggttttaggtttttaagaacacaggctaagggagaagaaggaggaatggagggtggaagtttgcctatagtgaaggaggcaagtttaaagaaaagggagagtagagacacggagggaaggggttcgggggttcttaccttccaaaaaagcaggaaaggggtcagggcatggaaataaggggttggggcacagagataagaggtcagggcgcagaaataaggggttggggtgcaaaaataagaggtcggggcatggaaataagggatcagggtgcagagataagaggtcggggcatggaaataagggatcagggtgcagagataagaggtcggggcatggaagtaagggatcagggcacagaaataagaggtcagggcacggaaataaaggattggggcacagagataagaggtcagggcgtggaaataagggatcgggggattcttgccccccaaaaaagcagagaaggggtagagacacagaaagggttgggatacttgcccctcccccagaaaagtgggacttgccgctaagggtgaaggactaaggcaggcatccccgcgtggtctgacacctctgaaacgtgggtgaataatcagagaggcgtccctgcaatgattaaacaccaagggaaagctgccttcctagtccatgaccagcgctggagttttgggtccatgggtaaaacatgtctcctttgtctctactagaaaatgaaaggaattgaaattaagagaagggagagattgaagtgtggcaccaagattgaaaggagaaagaggttgagggatagtgagggaggttggagaagagagtaaaaagaggccgcttaccagatttgaaattggtgagatgtttcttgggctggttggtctgaggacctgaggtcataggtggatctttctcacggagcaaagaacaggaggacaggggattgatctcccaagggaggtcccccgatccgagtcacggcaccaaattgcatgcgcgtccatgtgaagagactactaaacaggctttgtgtgagcaataaagctgtttatttcacctgggtgcaggcgggctgagtccaaaaagagtcagcaaagggagatggggtggggccattttataagatttgtgtaggtaaaggaaaattacaaagggggtttgttctctggcgagcaggagtgggggtctcaaggtgctcagtgggggaggcttttgagccaggatgagccaggaaaaggactttcacaaggtaacgtcatcacttaaggcaaggactggccatttacacttcttttgtggtggaatgtcatcagttaaagcaaggaccanccattttcatttcttttgtggtggagtgtcatcagttaaggtggggcagggcataatcacttcttttgtgattcttcagttacttcaggccatctgggtgtatatgtgcaagtcacaggggatgtgatggcttggcttggtctcaaaagcctgacagtaaaatatacataacataaaatataccatcttaaccattttttaaagttacagttcacctgggtgccgtggctcacacctgtaatcccaatactttgggaggccaaggcaggcagatcacctgaggtcaagagtgcgagaccagcctggccaacatggtgaaacccgtttctactaaaaatacaaaaattagctgagcgtggtggcttgtgcctgtaattccagctactcgggaggctgaggcaagagaattgcttgaaactgggaggcagaagttgcagtgagccgagattgcaccactgcactccagcctgggtgaaaagagcaaaactccatctcaaaaaaaaaaaaaaagttacagtttaatggtattaaattcccctaatgatgttgtataaccacaacaatcatccgtctccagcactcttttcacccgtaaaacttcatctctatatccattaagcattaaacactaactcctcatcccctggcacccacccctctattgtctgtctctatagatttgacaactctaggcacctcaaataaatggaattctgtggtatttgcctttctgtcactggcttatttcactgagcctaatgtcctcaagtttcatccatgttgtagcatgttgtaccatttccttcttttttaaggctgaataatattccactttttgtatacacagcattttgcttagtcattcatctgtcagtggatacttgagttgtctccactttgcaggtattgaggataatgctggcatgaacgtgagtgtccaaatatctcttcaagaccccgcttttaattatttcatatatatacccagaagtgaaattgttgcattatatggaaattctatttttaactttttgaagaacctccatactgttttccacagcaactataccgttctacattcccaaagcacacaagggttctgatttctccacatccttgccaacatttatttgtgtgagtgtgcatgtgttacagtagccatcctaacggatgtgaggtggtagtttggatttgcatttctctaatgattagtgatgagcacctttacatgtgtttgtcctttgtatatcttcttcagagaaatgtctattcacgtcctttgcccatttttgaatcacgttgtttctttgttcttgagttttaggagttctaaatattctggatattaatcacttatcagacgtgatttgtaaatattttctgttctgtgaattgccttcttactctgttgacagtatttttttttaattattatttgtagagatggggtctccctatgttgcctaggcttgtctccatttcctggactcaagggatcttcccactttggcctccccaagtgctgggattacaggcatgggccactgcacctggcttattgacagtatcttttgatgaaccacatttcaaatttttcatgaagtccaatttgtctatttttttcctttgttgcctgtgcctttggtgtcatatccaagtaatcactgccacatccagtgctgtgaagctcttgccctatgttttcttctaggaatttgttttaggtcttagatccactttgatttttgtatatagtgttacgtaagggtcaaattctgttcttttgcatgtggatatccactttacccagcaccatttgttaaaaacactgtcctttccccactgaacggtcttggcacccttgtcaaaaatcatttgaccatatgccaggcatggtggttcacgcctgtaatcccagtacttggggacgccaaggcaagtggccacttgaggtcaggagttcgagaccagcctggccaacatggcaaaaccccatctttactaaaaatacaaaaagaattagccaggtgttctggtgcacacctgtaatcccagctactcagaaggctgaggcaggagaatcgcttgaacccagggagtggaggttgcggtgagctgcactgcactccagcctgggcaacagagggatatgtctcaaaaaaaaatcatttgaccataaatgccagggtttattcctgggcttctattctattccactggtttatatgtctctctttatgccagtaccataatgttttgactactgtagctttgtagtaaattttgaaataaggaagtatgcgttctctagctttgttctttttcaagattgtttgtctatttacggtcccttgaggttctctattaattttagaatagatttttctatttctgcaagaacatatcattgggatttggatagggattacattgaatctgtagatgctttgtgtagtattaacattttagcaatgttatgtcttccaattcatatacagggaatgtgtttccatatcttaatgttttctttaatttctttcagccgtgtctcgtagtttctattgtacacacctttcacttctttggttaattcctaagtattttattctttttatgctattgtaaaacggattatttttataatttccttttttagattcttcattggtatcatatagaaacaccactgatgtgtgtgcatgtgtgttctgagcagggtctcacaatattgcccaggctggagtgcaggatgtgatcatagctgactgcagcctcaacctcccaggctcaagtgaccctccttcctcagcttcccaaagtgctgggattagaggtgtgagccaccgcactcagctgatttgtgtgtgttgactttgtatcctgctactttgctgaattcatttattagttctaatagtttgtgtgtgtgtgtgtgtgtgtgtgtgtgtgtgtgtgtggacactttagggctttctacattttcaaatcatattatctgcaaacagagataattttacttcttcatttccaaattgaatgccctgtatttctttttcttcttaatttctctggctagaacttttagtgctctgaatagaagtggcgaaagagggcatccctgccctgttcttgctcttagaggataatctttgtctttcactaatgagtaaaatgtttgctgtgggtttttacgtatggcttttacgttgacgtagtttccttctgttcctagttcgtttgtgtgtgtgtttttttttttttttttgacagggtcttgctctgtcacgcaggctggagtgcagtggcatgatcacagctcactgctgccttgacctccctggctcaagcaatcctcccacctcagcctcccgagtaggtgggaccacaggtacgcacaaccacgcctggctaattaaaaaaaaattgttttggcagagacagggtcttgccacattccccaggctggtcttggactcctgggctcaagtaatctagttgtaaaaagtttaaagctggtttttaaaaagcccaactttcatcattggcaggatgtgcgttctgataaaattactcttacagctagaaacaagaccctttccttgcatttctaattgttttgttccactgcggtatttatagtttgatgaagagcatcttacccctgcacagtgcttttaaactctgctgtgcctgatatgaatactcttattttctgcttgtaccctatttttctatccacttattttcagcctgtcacttttatgattattacatcaacagcatattcctgggttctagtttcaaccccaatctgaccacctgtcttctaaagagaaaaaacagatttagtgtaacaatgtatttcttggtttgtttaggaaaggacaccaaggttcagaaacaagtgagaattaggacttgaaagacaaatgggcggggggaacttcttagtttgtcttttgaatttttattactttttcagagatgaggtctcactgtgttgccccggctggtctcaaactcctgggctcaagcaatcctcccgtcttggcctcccaaagcactgggattacaggcgtgagccaccctgcccagcctagaaagcatttttgactgaaccaaaaatgcaaatcctcaccaaaatctctcagtgaagtcactaagctcccattagagtggagtgtggagaggccaagggcactcacctagtgccaagatcccacagagaaacatgaggccagggcatgggcacctcctcccaacaggaccccgtgactgggcctttgaaccattagatgcagccctggagccgcggtcagagcgtggctgtccccgagaagggaagcagcagccggcacggcctgttctcccatcttcacatcactccctccatacaaaccactgcttcccaccgcctcctgtgacaatgcctggcgaggtggtcatgcccccttcagccctcctgaagtgccctctgggaaataaggcacgacggacaaatggattcaacatccttttctttttaaaactaaaccttgcttgaggggcatggtttggatgagttctctgacttcatccctggattagacaaatgtccccccctggtcacgggcagaggactccatgagacgtgtctaacccagggatgcagacttctcccttcggcaggacagagtctactgtgtggaagaggacgatccggaacgtgtcctctccatgggcgggcaaatccaggctggagcccagagcatgccctgctcctcggtctctcctccttggcggggtaggaaaggcagtcccggggccacggtgcatgccatggggggtgttctccctcacaatgctttctatgctgcacttttaacttctccttttccttagttctaaaagattaaggtgcaaatcacatacaatcaaatgcataggtcttaagtgtaggttttgatgagtttggacacatgtatacgttcacataaccaccatcaccaacaagctgcggaagacttccctcaccccagaaggtgtccctgtgctcttttcagccaatccttctctcttccctgccaggagaaaacactattcgaatttctcccatcaattcgtttggtcggttttagagcttcgtatagatgcttacatatcttacttcttttgcttaacgcatttatttatttatgagacaggttctcactcttgtcacccaggctggagtgcagtggcacgatctcagctcacggcaacctccacctcccggattcaagtgattctcgtgcctcatcctcctgagtagctaggattacaggtgtgcaccgccactctgggctaatttttgttaaaattttagtagggacgggttttcgccatgttgaccaggctagtcttcaactcctggcctcaggtgatctgcctgccttgacttcccaaagtgctgggattacaggcgtgagccactgtgtccagccttcaacgtttttgagacgtatacacatggctgcattcatcacggttcacccccgttggttactaagtagaagtccatcgtatgactacaccagaatctgcttatccaccctcctgttgttagacatattacgaataaagtgacaataaatatccttgtacaaatcacctgtggacatgtatttgcactgagtatctaggagagtctgcaggagtatgtctaattttttaaaacctccaaaccaaaaaaagaatttgcccactagtttcctaaactggaagtattattttagacagtaataggtgagttctagcagctgcacattctcctatctggtgatgtctttttcatttgaacactaatagatggaaaatgggacctttttgtgattctaacttgccctccccaggaagtgatgatgttaaacaacttttcatgttcttattggccactcatgtatacacaggtccctgacttaagacggttcaatttcaggtttttggactttacgatggcgtttcggaagcattaagctctcagcagaagccacactctgaattccgatcttttcctgggctggtgatggatgcgcagcacagtgccctcctgcagtactgagcggtggcagggagcagcagtcccagccagctgtgccatcgcgaggggaagtggccggcatggatcgttaagtcagggaacatctgtcccttcttcgtgaatatctgtgttcaagtctcttgctcatttgttaaattgggcttttcatcttaattttggtttgcagttttctcccctatatccgaggtctgagtcctttgtcaggacacacagtgtgatttcttgcctggcattccgttccttgcttgtccattttcaagagcagaacattttcacgttgatggaagcccgatgtctttcttctacggtatgtgctctgcatccaaagcagccttcgcccatcccacattttagataattttttcttctaaaaacttcactgtttaagcgctcatgtttggatctgcaatctattttggatgaattcttgtgtatgacgtgcagtaggaataaaggctcatgtctttccatacggatagccagttttattcacagacacaggtggtggccagacctggcacacggatgcagctgaccctggaagctgaagggcagtgaaacccatctgattaagatgctcaacttttctgaaggtaaaggttttaaataataggtgggattgaagtggaaatttagaaaggctagcaggtgacattatggggttaagtgagtaaaagttagctaatgtttgttaaacatttaccgtaagtaaaaagctattcaagtctttgaacttgttcctattgtttccccacccaacagaaaaagctgacaccaagacctgcctaaggtcacaccatcatgagtggctgagttgggctgtgatgagccacccggctggagagcttgtgccctggttacacgattgccagtgagatgcctatggactcgcatgtagaggtgggtacccagacagctcagagtgagctgcctgcgggcccagcatgcagaggtgtgtactcagtgctgtgtgagatgcctgtgggcccaggcacggagggatgcatgcgtgcccagaaagcaaaaggctgtgcagaggacctgctaggaggtaatgactagagaacatgtttttaagcaaacaggtgaagggaaaatgcaaaataaggagctacataagcatcacatcttaagaatcattatggagcacctaactgtgacttgttgggctgggagccaaacaacataggtgggacacgctgcacataaaagtaacaagctggaggtccagaggaacccttggagccgtcccaagactgagagccggtgtcaggcaccacctcttctgggcacctgggctatggcagtggggaggatgagcccctgatcccagaggccactctctcacacagtgcagtgcagtctttctcacacaggacctagtgtaacacgggacctaatggcaggacacatcaacccattaaaaatccaagcaaggtacaagagatttctagaaacaaagaatcaggctttatttttgttattttgaatacaggtattgtattgtagacatctgttagtctcataattcagtatggccaacacacagaaattaaaagtagaaacaaaatgagggcacacttgctcctgtccttggcttggcccctccaacctccaaaagaactgtcctccccattgtcatatcctttccctgctacgaaagacaaaacaaaatgatgccccaaagaaaagtcccagaggctctctcccagcagtcagtgggatgaagcaagacactgttaccttgggtaggatggagaagccaccaggtccataccacagaggccacagtgggatggagaagccaccaggtccataccacggaggccacgtgtgccaccagtggagccaaaccctggccatggctggcaaaactcaccaccaggcgagaccagagcatattatctaccagtaatccccgaggtccaacgccattcaagtcaggcagccctgaggcaagcaggaggagccctgtcctctgggggtgctgcttccagaggaggcccaaggacagtctcttcagagaggggctcacccgggaaagggggttcctgaggaggcgtgcaaaggtcaagggacccacccttgccacctgtcccagggcttactgctgactccactgtcctgggagtgctggaatctccacaccacttaaaatgaaaaaggaaatcagaaataataaggcattagacgtttgattcttttatttccatatgcaatgtaatgtttaggcacgctgcttgggatgctacttctaaaaaaattgttggccatttttcagaatatccttttggttttaaatactggtcaggaaaaacaaatgatgtaaaaatacgtgaataattttctattacagaaatgaaaaactgatttgcatctaaaagtgcaagaggtgaagtaatttaaccctttcaccagacgatatggcaatatacaatatattgcttgagctgtttgagaaggctgtgatgtatttttgtattgacatagaaaattataaattacattgaattagtatccataatcactatatatatacacaaaccagttctaaaaaaatacactggtttaaatttatgagtgaaaacctcacaaggtacagtaaacaattagcatgcttcggtgccagattttgatttctacttttaaaatactagcctgtaaaatgaacgcactctaattccattagcagcacgagcattttcaactgacttgcctaataggatttattttaggtctgttaaatatgcagattgctctgaaatgttcattggtgatgcttgttaacaaggtaaattttggtgaatgggttaaaaggcagatgaactaccaaatgaaacaaaaaaacaaacaaaaacaaaagccaaaaaaaaaaaaaaaaaatcccaaaacacaagccatatacactccaaatagtctagtgtttcacttgtaggaataatcatttcaagcaaacaagacttgaacagaacatatggctttacgataacatcaatttatcaactatgatgtagcaataaatactttacttaatctctaccaatagacttacatttttgatccgttttaaacaatacagaaaacaattaccaatcaaaaactggttataaaaagaacaccaaatatttcttattcaaaatcacttttgtaagttagaacaaccaaaataacacttagagggcattttcattctacaactccttgtcggcctggaggaaaaatgaattcataattttgtacaaggtgaaaaatgtatgaaaaccgcctaatactttggtcacactaataattgtcaaagttatgtttcaaatacaatagatctgtgtattcacttttataaaactattcttacagccattttaactatagtattactactattattacatgggtggcaagatcttatttcacaggctacccattatttagaacaatacaatataaacatacgcaaaaattcttggtatttgtcaatgtgcaatatttttacacttctgaatttctctgtacaatgtcttagaatctagaatataaaggttgctggtcctgatcccttgcagagtgagtgcagcagtgacagcttggtgggctccagctgacccctccagagcccctgagtggtggcggtctgcagtcctcagtcagcagcagcagacgtcacccgtcatacagggccattcactgaagtgtcacctggtgcgcttggttggccagtcctaaggagcaacagacaggcatcggaggcacttgcagcagaaatatgaaaaacaaaacctacttagctgagctccccaagggcagggacaacttattttaacattgttttgaacttagtaagtttttaataaaatgatatgtaaatgaatggagcaaaagctctagaaaaatctgagtgagtgcatctaagcttcatcaccgggtgagcaggcattcagcaagggcagcagcagagcaaatgctctgggagaaccgccccaccgcggcctccaagaagcacagggagtgactaggtcagtggggtataaactgtggcttccagagccttcaggagctatgtgttcaccgctccttcaagaaagcttttatgtgacccacagattggaatccacatactatttcacttggaaacaggattctgctactaggaaaggggggaaaaaaggaaaggaaaggaggtttgcaaataaactactggaaaaaaaaaaaaaggtgtccacttgaagaacatgtcccacaaagcaaatgttaggctcaaaactgggagggaataacaggtgggacagtatataacaaagtgtccaggttttgccttcctgccaaaattacaacctgaatatataacctattcgggaaggcttgaccaaaattgtatcaagcagacttgggaaagggtgcttagggccgtaactgggatgcccacaagcacttttccactagcattcacaatttacagctagaatgctactcatgccttatacctgctggttatacagtgagccaaaaagtcagctctgcacacacaatccactctgctcacttacttacatctgatggtggctccgtgtatgagagacataggaatcgagacttctggaactagacataactggtatataactaacttgccttcacttaaacaagctgagtgatcttataagtagatttcttagcccctctcagttctgttttctcctctgtaaaatgggaaaagaaccctccccacgccccacagggcttcactagtatacatatgaaataagtacataatgtgtgcagcatgctcagcacatcagaagcacaaaggacatgcttgataaaacagctgtgaaaagtgagatcatgtggcaatgcagatctttaagtgtgacaggaaacagcgcgcctgccaatccaaggaactgtggtatctggctgggacgggaaccacacaggaaagacgggtgggcttcaatatcccatgctgtcatacgtcactttagaacacgtgcaatctaggacgcactctaggtctgccctaatgcccactccaacgtcacctcagagatcctctcccccgcaccccagctcacatggacccctgtcccttcttcgtggcttcttgatgaatgtgcctctagtatgccccgagaccactaggtgtccgtgtgctgcagctttatgacccggcctagaccagtggccaccacacacaaacgtgtgtcagaggaaagaaggacagatggataaaggcatggacccaagtgatgcccctcttcttccactggctgaccccatcttttcctccatcccttggcccggcaggttagggcagggctcttcagagcaggcattcccagccacagaggagagcaagtggcttccccttatgcaaacaattcttctgtgctcagaaagccaaggaaatgactccagagccttgtgcatccttatgacagagaaaccaagaatattcccctgaagcaactgccccaaactgggatagacctggacgatcctgcctaggcagccctcaatataaaggaaatttataggtagaaatcagagagctgaaataattgattgggaatgagacctataaaggaccattaaaaaatacattgaaaccccaagaaagagagtgacttgcccaatccgtagaagcagagttgaggcagcttcccagtgctagagggccaccctgcctcttcccccaaaagccttcactagagccaacatgctcaaatagttcttaatttgtttgttttatatgcaaaaaaaatatttctaatcacaaaaacaaaggctttattttggctacaatttccacaggaggaacacaaacagcttgctacactgtgaatacaggattttggaccaacaaagagtgctccctgctggttcccactggttatgctctcatacaatgctggcaagatttgggggaggatggggtgggggtggggggttaaaacttctctgaaatagctttaaaggtcattttattccttatggaaggaatatacaatcttagctacatttgttcacagaagttgattgtgggaagtgctgaacaaagcttcctgtggcccaggggtgcagcctcatctttgggccatgctcagtcttgctaagggcctggcatgggctccgggtggctgagacttagactggcccatcccttcagaccactggctcaggctaagcaaaaagtgactagaaacaaaacatcacattctaagtcacacagctctgggagtgggcatttcatacttaagattacagggagtcacttaagcactaagaattatttagctacatgtatgaaagggctccagcaagttctccttgtgtcacacagggcaggaatgtgggcaaataggcaccacgatctgctcgtgcctggcggctggatgactttagtggggccaatgagaactcaagtcctggaggggctcaatgccaccctcagctcagtacctcaacaacaagggtgaggagacccctctgttcggagccacttctaaaagagcgagtgatgttaaagagtctctaaaaactggttttcagtttctgcgctaaggagaggaactgctgtttctaagttctcagctcagtcggactcagctcattaaggactgagaaaaccctgtcctgccaggtcagcggcctaagacttgagcacagctgtaaacgatccctatagtcccctcccaactcccaggaagcaacaggcaaggtcagggcagggcctgggtgggtttgaggaggcgggtggttacctctgctcgggactgctgctgggaggcctgggcgccgcgcacttcgcctctgcagtctcgggacactcctctgcgtctttacaagcagcatcttgagaggtagacagtttcccttcctcactgcagtaaagaggatgacaggcacatcaaacaccctagggaccagcacctaggcaccagaggatgaggtcacatgcagatggctctggagtcatgactgccgcggaggcaaagcatcctgggactgagcatgcgcagggtgcacgatcacacaaccacagacagtgactggggaatcacaaaaggaaagggtcgcacacaggtgggaaccaaaacagggacaatgtaatgtggctggcgtctgataaagaacggtcccataacactgtacataccgataggatttcaacactctgaagcccagtgtgcaaaacagaaaaagaaatgtacaagagtttcagaatactcctagaaatgaggaatttgggggaataatatgtccacgactgcacgtaagcaaaactgcagactcggtgaaggtgtcaaagaacctgtttgaaggaatgagtctttagttaaagcactttgcttttggggccaagcccaccattaaagcagcaagacagaccccatcagcttgctggctggaagcctcagtcacatgaggtcaccgtgttgactgcatcggatttcacggctcctcgagttgccctcgaacaatgtgtgagaagcacaaacgccagagggagaagagggggccaagagctgatcctaaggacacagaggatttgggtaaaatgagacccagaaggactgtttttcccccttagatggttcttggtggagaaagacacaagagacactctcctcagctctgtgggctagaaatttagactctgcctattcagtctgggattcccctttttacataatcacaatggcactaataagagtgaaaggtccatcactcagagctgattctgtcctggattttgcttatgaaaaatctcatattaggatgcattcttgggtcgtttccagatagttccaagcaatttataagtaggaaaatgagttaaaatcatatgatttagtgatcatctgaattacctggttccttctttgtaaagttactcttcttcatccccattctccactcctttcccttcaaagcaactaatgtgtttctaattctaattctttaaaaaatagtcataacacaatgtgtattctgagtcgctaactgggatggattcaactctacatctcattgtatttacctcttaactcagcaagtcggggagacccactgtccccactgactgtggcacagcacccgtggcgtgcacctaccactctacatggcttctcccaaccaaagctgccctccacctcacacttccatgcagggtgctgtgacgaccatcactgtccacggcccctggcagacctgtctgggcgtttctcagtacttgacacccaggagtgaagagttgtaggccatttttctacctacaaagaagcccacgctactacccagaatgactgccctggtctgtattcctcaccagcaggccaccagggccccgcaggctgcagcccaccgccactcaacatcatccacctttaactgctgctcgtgtaagaagagtatcaagtcctatattgttatcgtttataattctctgatgagttttgagcatttttgtttgtttgtttgttttagcttttaaggcttgtctataaacttatcttttgccaattttctaatttgggttttcttcttcttactagtttataggaagtccttgaatatataatgtcagtctcttgttgatttagctactacagatgtttttttcagtttgccatcagcctcttaattttgtctgcagcattttatcaaccagaaattcttaactttaatataatctaactcaactctttgcattatagtttctgtttttgaaggcttttttttttttttttaaagaagtcctgccgaggaaggaggctcacttgaagccaggagtttgagatcagcctgggccacaaaaataaaaaagtaaacaaacaaaaaaattaagccaggagtggtggcacacaactgtagttccagctacttgggatactgaggtgggaggactgctggagctcaggagttggaagttacagtgagctatgattgtgccactgcattccagcctgggcaacagagcgagacctcgtgttaaaaaaaaaaaaatctagattagatatagactgacagatgatagattagataggcagacagacagatagatagatagatgacagacagatgagatagatacagaagtccctttctgcacacaggttaaaaagacattctgtatttcttttattaaccatcatgagactctggcctccggcctcatcacttaactctagtgcctcagtttcctcacctgaaaagcagggataataatcccagtacctatcttatagggttcctaagaataatccatgagctaccacacatggagagtgtagagagcagggcctggtccacagaaagcactgcacatgtttttcttattgtcttttaatccagctggagttgttttagaatgtagattagggaggatcttgcctgacttttccttttggtgaaccagcccttcctctcccttccccattattaatccctctatttcatcacactgacacctgtacctgtttggacactaatatcaaaactgttccaatcactgtgactttgcagcgtgactatctggcagggcaagtccctttttcaatcttcccttttggttacctctaagcaatttgggaaccttcatttttccatataaattttagagtattaagttacttctaaaaatccaactgaaatttggattgagactgcgttaaacactaacttcaggatggcagatgtctctgcagcactaagctatgccatggtctccacttgtccagatttctctatagagacttgggttaagatcattcctgaataatttatattttgatgtattttggaataataccttgctttttatgttctggttgcttactactgatgaagaaaaagactactgattttttaaactgatttcttactcaatagctttactgaattcttattagttacaagtttgctactgacttggttgtaggtaatcattaccacctgcaaagaacaacagttttatcacttcctcctgatctttacctataactctatttccttttccttccaggactgcctaacactggcaatgaaaatggacatcctttaaggcttcatcttaaagtgaatgcatctaaactttcctcattaggtgttagttttgctgtagcattttggtattggtatttaacttataccaagttaatgaaattcattgccaggcgcggtggctcacatctgtaatcccagcactttgggaggtggaggcaggtggattgcttgagctcaggagtttgagaccagcctgggcaacatggtgaaaccccatcactacaaaaaaaaaaaaaaaaaactacataaatttgctgagcatggtggcgtgtgcctgtagtcctagtcccagttacttgggaggttgaggtgggaggatggcttaagcccaggagacagagattgcagtgagccgagatccacatcactgcactcatcttgaagaagaaagaagaaagaagaagaaagaaggaggaaggagggaggaggaagaggaggaaagaagaaaaataaattcacttctgttactggttttctcagagttttaatcatatatagctatggaaccttataaaaaaaatcaaatgactgactttctgtctaacaccatatatggagattaaactgacagatttctctgactttgagccatccttgccttccaggataaaccctaactaatcattataaattatttttaatacactgttggatccagtcagcaaataccttacacaggatttttgcattcagtagcctgtaagtggcatgaactgatcattttctgtaattatctttatctggttttggaattcaaatttcactgccctcataaaaagagctgggcaggttttgtactttttctatcttctctaacaacttaagataggaattagtagactggtgagcacgaaatagcatttacttactactgtaactgacaggtcccatttactctggatttggtttgctccttgttttcctccacagacagttgcttgtttgcatcctttgtccatttaaaaaaattagactatctctcattgatataaggttatttctaatatcctggctactggttctttactggttgtggcttgtcttttcattttatgtcttctgggatattagaaattaaagtcaaacttaccaagattttcctttatggtttggctttttatggttaaaaaaatgccttacacccaaactgtaaagatactctcttttgttgtcttctaaaagctgtacagttcatgcttttcatatttatgttgagacaaaatatctaattttatttttctactatgtggataatcactatttactagtccactctttcctcattgaattataatggcattctaacatgtaacaagttcatgtagtggagggggtctctttgtataattctttgccaaagccacaccatctcagtagctttactaagttttgttttcgcttttgtttgagacagggtctcattttgtcccccaggctggagtgcagtgggggacacagctcactgcagcctcgacttcagcacccccaagtagctgggaccacaggcacacaccaccacactcagctaatttttgtattttttgcagagacaggattttgccacgttgcctaggctggtctcaaactcctgggctcaagcaatctgtctgcctaatcctcccaaagtgctgggattacaggtgcaagccaccacactcggccagctttactaagtcttgatatctaatatggtgaagcccctcacttttttctttaaaatgtttttggctattcctggctctctttggtcttatgactattacaatcagtttctcaatttccatgaaaatctctattgggattttgatggaaatttcattaatttcatagactaacttgttcagaaatgctaaaaatatcttcacattgataaacatggcaaatcttggtatttatattcaggtcttcaatatattccatgagattttaaactgttttcccataaaggtcatattcctagttatagataaggttttacatttttattaaaaacaggcacatttggaatatcttatattgatttataggatgcaagtgattttgtatgtctccagtaaacctgctaaacttttctattaatccttatctacagattccattggaatttttatgtataaatcatagcctatcaacagcgactatttatttatttggaatgctgcatttgctaaggccaccagcacagtgctgaagacaaatagcaactgtaggtcccactttctggttcttgtctttaaagggaatacttctaatgcctcactgaagaatcaagtctactctagattttctagagatacttaccagtttcacctatttactttctattcctaggctgcaaagaaaatcatgaacagctttaatttgtaatcaaatgcttttctccttttgtctgggaattactctgaataatttttaccatgtacacactggtgtttacattgtgtcactggagcacatatccttggtcatgactttaaaatacattgctacatttggtttgctagcttttaacttaagttttgagaataattgctcatgtatgaaatcagtctacagtcagttttcttctttcactccttgttttgtagtgacctcgcaataagcagggaggcattccttcttgtaatggctggaatggtctctaagactaaagctctaagcacaggcttagcttcagtccttaagttttgacagacatttttcccattattctctcagttttaggtttttaatatccattacaattccttttttgagtttagaagtgaatttctaagggtcacgttcttttaaagctatcattttgctactgaattttcatgactgcattatgtcctgagataatcatctgtatgttactgaaaataagtaaaggtttttgtaaaaccagtcgacctgaaaccggttttcatgggccatgctctgtagcctgttacacaagccaatttctattgtgattaaagatttatcaattctcatagttctatcaaactgctagatgtaaaatacagtcttctgaacacatttatgggggaaaaggcacttaggggcctaaactctccatctcttcattaagatttattgtgtttaatggagacaacagaaagacatcaagctagtatctgaacattcatttgaatcaaattaaaaattttaatgtttgaggtttctgccccaccatcctcccaataacctgaagctaccagcaggatctcacccctggttaccttttgaagaccgcagtctctgtcttggcatctacagtgaggctgagcgtttccttcatgccgccattcatcactgtctcagttaccttgtctgtactttctgcatcctcctctccgtcagagctggcttccatggccacactgcctgccgctgaaaagaacacagctgatggtcacacacagcaagcccgaaaaggaactggcaccccaccactgtacaaacccatctacccaacgtgacatctactgcttgaagaaaaaaaagagtgagatggcttctgcctgctgttgtctgggccacattcttgatggggagagacttcttaaagatgcccactaaagaggggtttcatgggttttctttactagagactagcaagtcgcctacatccctcccagctcagcgtccacctccatacccagcttctcccagcagacacttgtgctcctaactgttccagtgtggggcagagcaggcagttacacactctaccctctactcacttgttttcctcagttgggctctatttgctttgctttgttttaaaaattactttcttgtggtgttgctggtggatcgtttctttgttctctaatgggaagccaacataggtgatgagcctggctgaggtgaggcttcctggattcaaacatcgacatcaccacttcctagctgtagactacttggacaaggaacctcatctataacctgagtttcctcatccaggaaaggggatcagtgcacccacttacagaaccactgaggagtcaaatgcgggaatctgtatcaaatgttcaggaggatgatgaaaccagcattagttattggttttattcctttcccttgcccctgggaaggagggttctcacaccctctaccaaaacctcatttcattttctaagaactcactccttaagcccacctcatgattcgtgccctccacatccttttggttcccatcacactccctttgctagcatccccctcctcccaaagccccgtccatcaaggtgaaaacagttcagggccgtgcaaggaacacatttgactaggtagagtaataggaaaacccactggaactttagagattcccaggactattcaatctgcttacaatggcgaagtgaaaataaccagccccatagctctaaacaaacccagatacacctacatgcttgagcaaagcaaactccaagggacaactacacacaggcttggctgcacacgtctaattccagttttattcaccctgggtactatgggcttaggccttcttccctctagacctcagtttcctaatctgcacactgcatgcctggtaacttagagcccttactctttccagagtcagcatgctgtggttctagaaggacaggcacaatttctttcatcagctgccctgtggacatcagacccaccatctcactcccgggctccactagcccctgagcctgagaatcaggtctggtttgacaaagcagccacgtgaccctggcgtgtacccaggcctctctgcacgcaccttctggctgcactgccagggcagccgcactgggagtcagagggtccatgggttcagtgctggtttccatttccactggagaattactccttaaagaatcttttgtgctttcaaaaaagagaaaattcagatattagcagcagggaatggtcctcagttaccccaagattcacaataagcctttacaagtaagtttttgttaggagacattagcatctgtgtaagagtcactgggttacaaactccagtgacacatggatctaagtgccagtagctgtttgaagaaggacatgagtgcgggcaggcaaatgttctgttaagccagcaaggcagtaagacagggactttgtaaagcattctagacaggctcatcatgtcccaacttctcatcccaccatagtcactaggaggctcccagagcttgaacagcaaagacgtacattgtgcaatggcaacggtatttatcaggttgactggttttacaaaaacctttacttattttcagccacactgcctgggagagactggccctcttaatgatatttgttgttggaactgtggaaacatagtaaaaaaacaccaaatgcctgagcagtaaggggtaggggtgagggagatcattacacttcctcttttatccctcattcccacaaactcagagacgtgcacacagagggtaaagagaagcaagctgcttcaatcacaccctcaagtaaccaaaggctcttatcctcgggttataaacagaccaaaaaaaggagtaggcggaaatgtatgtcctgtactgaaaagcggggtagacgaaataactcattattttggagacatttttcacaaatctcacttgtacctctgagtagtaacttaatgctattactatggttactacaaagcaacatgggtttcagcctattctttggtttgtctaagacactaactgtcagcccaaaacagcttgtcttcctatcttccgagttaccaatgattgggagcccttaattgacagcactggactagctgcaagtgaactgtaagttcatattatctactgaattcaagatccattttgtttgcctgccacaccccacacagaggtgctgtgcctgtcaggatttcttggcttcacctcattcctcttctcctcaattctgtcctgacagctctatgaagccagaaaagctcacggagatgcatcttctgctgcgtcctgctaactccctgggaccgcatcctcacaagctactttgttcaagaactactcccatttccaattaatccaggaggaaaggaaaggaagatggtgattgttcttcttacaacacagagctgtgttagtatgctgatgtttaatctttttcagggcagtatattcaacttggaagtcagtcaaggtgaagaacacacgttaacagcaaacacctgaccattcccaggtcccccgtggaagggtgtagagacagcacatgttcgctcacctcagggaagacgtgaactctgaaaaagaagcccagcccgtctctttagttggcatcggctcctctgtgctccagacatcagatcccacagaatccaatggagcaccgtgggttgtttccattgggacatcaaagttagctgaccagttgggtgctaaaaagaggggagaaattctatttggaaaacacttcagtcgtttcatgtaccacaaggtatttatcaaaaacacattagcaaaagagactggagctgtgggagaaagacactctcaccaatgagggcaggagcggacagggcacagccacctggagggcactctaacaatgatcccacattctcaaacctcccatttctttttattattatttttttgagatggagtctcgctctgtcgcccaggctggagtgcagtggcacgatctccgctcactgcaagctccgcctcccgggttcacgccattctcctgcctcagcctcctgagtagctgggattactggcacccgccatcacgcctggctaattttttgtatttttagtagagacaggtttcactgtgttagccaggatggtctcaatatcccgacctcgtgaaccgcccgccttggcctcccaaagtgctgggattacaggcgtgagccaccgcgcctggcctcaaacctcccatttctaacaactgttccaaaagaaatactacacagagattcaaagctacatgcacaaagagggattaatgttaatttcttagttttgacaaatgtaccatggctgtattcatacttggggaagctaagtgaaggatatatggagacttactatcttggcaatgtttctataaatctaaattattcaaaagtaaaaaggttatttttctaaaaaaagaacatgttgattattcaactccaataaactagaaataaccttaatgcttcccagtccgggtctgactgcacttcgcccattctgcgggctccctgcagtgcactgcagttaggcttcctaagtcctgcagaaccaggtctggcctcagaggctgaagcggcaggacttgcttgagcacacttacggtctgtggggctcttcttactatgctgcctgctggccaagtttgggtctaatctgcaggtctctccttaaatgtcacctcctcagacatgtgtcccttctgatgaagtcaggtcactgtggatctgctctaactgcacaccatgcttttccttcacagagtgctgaatcctcaattctttgctggggacaagccagatgtgggaaccactgcattccatcagggatattatcataattaggaatctctaggttgcaggaaggaatgctagggaaactggtataagttatttaagggcttaacccagacacaagtgactaagattaagaagtacccgtgtagaatagaaatgttctgagtttaaagacagacttgactgtgactttccccaagatatctgacttcatctgtttgatttcataatgactattcacttagcaaagatcacaggagggcctgcacagagtaggcatttaattagggtgcgctccatgcttcttgcccacctacctgtgtgagtgtcacagggctccactgacaccaagaaggaataaatgcttgaatgtttgaaaatctcacctgaaacctccaaaaagtcaacttgacagttatttttgcctgcccactctatgcaaagctctggaatcattctatctgagttctactctacaactaaattatattacacacaaatgacttttctgttatctctttgagatagtctttcccagatgagctcctcagagtccgtgtaacattttaaatgattctgaatgtccacaaaacctccaacagaagccacagagactggtggaatggcagaggctctctggggcaaccctgtagccctgaagccctgagagagaatcttccccaaccctacccacttgtgtctccagagatctgaagatgcaaaagctgtctttcccaaggaacagagaagcaggaggcctggttccctgccacacttaaccccgggaggtaggtaaacgcgaacctcatccagggtgctcgcctcctcgctgcttatccctacacccaggcccacagtcacagcagcagcggcacgcagtccagccaagtgtgtttccctccctgtcacttaaccatacccagcctgctaaaagaaccaaagattccagaatgtcattcggccttcgaacaaaaggaaatcctgtatacaccacagcagggatgaactctgaagacattatgctaagggaaacaagccagtcacaaagataaatactgtatgattccatttatatgagatccctagactagtcaaccccagagaaacagagagtagaatggaggctgctagggactggggaagtagaaatgaggaattgtttaatgggtacagagttttagtttaggatgaaaaagttttaaagacctgttacacaacagtgtgaatatactactgaactgtactttttttttttccccagatggagtctcactctgtcgcccaggctggagtgcacagcatgatcttggctcactgtaagctccatctcccaggttcaagcgattctcctgcttcagcctcccgagtagctgggactatgggtgtatgccaccatgcccagcttttttttttttttttcagtagagacagggtttcaccctgttggccagggtggtctcgaactcctggcctcaagtgatccgcctgactcggcctccagaaagtgctgggattacaggcctgagccactgcacccaaccttgaactgtacattaaaaaaaccaacaacaacaacaacaaaccctacagattccagagccaacagatcagggcatctgccctgtctcctcctcacacctccctgctgcctggagcccatcttgcagttctcattatttctcatgtgtaacagttcaatgtcttcatggttctcctgtctctaccatgcgttttctcgtccatttttcactgttgccatgaatgtcttgaaacagaaccaataatgatcttcttagtcaaatcctcaagggctccctacaaccttcagaatacaactcctgatctggcctctggccttcgctcccgccacctcatccccgagccatgcaaaacagcacgttctgggcatttggattagctgttttctctctcgcacgggcaaatccctacgggtccttcagcctcatacccacctgcctctacaaagaggcctaatggaaggctcccctcttctagcaccctgtacccattcccctgcactgcccatctgcttccccagccgaccccaagcccctggaggcagagtctgtggcccgttcacagttacaggcctaacacctggcatacagtaggaacttgacaaaggcatgttgactgaaactgaattacggacagaaaagtccacttcctcctcctgagggtgggctggaaaacaggcagcagaaagaagatctctcttcttctcccatcccgtttccttatctgcaacatgtggcagtttgctggatgactgatctggtcccatctagctctgaagtcaccacaaggtccaccctagctgggcttcagcctctgggatgaacataaaaaaggccttgcagggcaatcagagactggccaggcttggggcaagcctcgctatcagcccatatggctccttcacatgaacgtttgtttcccaaacctttagaagtttttgaagtatttttaaaaggccagctaactcaagtcttcctagcaaggagcagggcacaagcaagcactcagctggacaagtttcaaggctgtgagcttctgaaatcaactacgaagaacgcactgaaatgcttgttaagctaaggctgcgtcccctggctgattccactcacgaagccacacaacacaaccatgtcctcctcttcccaccaacacagggccttttccttctgcaagagcacacagggtacacagccagaagactgacctagcagtgggctctgtcctccagccagacccacacagctgacgttcatttcctaccaggaaggggaggtaccttatccacaaatgcattctgtgctccttccctgaagctgtctctgaaacttaaacctccaagaggaattcacttgacaacacgcttcaacccaacctttccttcagatatcatctcagatgctgtgaactgctcctttgccaattgttcacaatacctaattccaacacagggcagctgatctgaagaatgaatccacttacgttcactcaggtccacctccattttatcctccgtgttggcactgctgggttcaaacaagtcttgctttgctccatcttcttcttcagagtctgtactttcctcactgtctgtactccccgagctaaggaaaaacaagacccaagtatttaacactgcttatcagccaccagctaaatccagaaaattctaacagtcatccagcaacaaaaggtcctgtggtgcttcagcaggatcacatctgtctgagcaccacgtggtcaggatgcccgggaagactcagctttgcgtgcgtgctgcccaacctcacactaagcctccaccacaggaacacatgggctctgcttaaagtggaggccacaatctaagaaccaccttctcgaaggggtggaggtgttcatttcactgtggtgttcatttgtactttcctaatgaccaaggaggttgagcatctttttaaatgcttatttgccatcttatatcttaactgtcttttcacacttttgtgctttttaaaaactgaattgtctttttcttgagtaaagagatttcttaactctatacacaagtcttttatctaatgtgtcatttgcaaatgttttctcccagtgcatggtttgtcgtttcattctattaaaagtgtcatttgaagagtgaaaattttaaattttgatgatgttcggcttactaaaatcattcttttatggatgggcatggtggctcacgcctgtaatcccagcactttgggaggctgaggcgggcagaccacctgaggtcaggagtttgagaccagcctggccaacatggcaaaaccccatctctactaaaaatacaaaaattagctgggtgtggtggcgggcacctgtaattccagctactccagaggctgaggcaggagaatcacctgaacctgggaggcagaggctgcagtgagctgagatcacgccactgcactccagcctggacaagaagaacaaaactccgtctccaaaaaaaaaaaaaaaaaaaaaaaaaaaaaaattatttttatgtattgtgtttttggtgatacatctaagaaatctttgtctaactcaaggtcacaatgattttctaagttttcttgtagaagttttatagtttaatgtttcacatttgggtctaagatccattttgagttaatgtattatatagtaagaggtacgaatcagttcacttttttgaatatggatgcctgatggttccagcaccatttgttgaaaagactatcctttcttcactgaattgcctttcgcctctatcaaaagtcagttgtccatatatgcgtaggcctgtatttatgggctctctattctgttccactgatctatgccctaccttcttgcccatatcatactgttttaactattgaattttaaaataaggtagtgtttgtcctccaattttgttgttctctataagagttgctttggctattctagatccttttcatttccatatgaatttaagaagcagcttgttaatagctacaaaaaaggctggaaggattttgtttgtgttgaatctatagattcaacctggggaggagagctggcagcttagtattataatactgagtcttcctacttataaacatttaccaagttgtctttatctcagctatgctttaggcttttcagcatacaggtcttggacatgttttgtgagatttgtccctacatatttaaattttttctttttttaaaaaaatagagatggggtctccctatgttcctcgagctggtctcgaactcctgggctcaagagagcctcctgccttggcctcccaaagtgctgggattgtaggcatgagccaccatgcccagtcatatttaactcactctctctctctctcactctctctctcactctctctctctttttctctctctctctctctctcctctctcctctctctctctctctctctctctctctcccccttttttaagagacgggggtctatatcgcttaggctagaatgcagttattaggttgtgtaaacatttaaagttgctatgtcctcttaatgaattgacccctttatcattatatcactttctttatccctttcctttgaaatcttttgagattaatacagaccttctggctttttcttagtgttaacatatcttgttcttttttgtgttttcatatatacttgtttctttgtatttaaatcatttcccataggcagcattaattaggcctcattttttatccaaactgaccatctttgttttttgtttttttatcttggctccctgtagcctcgacttcccagcaatcctcctgcttcgcctcacagcaggcacacgccaccatgcccagctaatttttgtattttttgtagagacagggttttgccatgttgcctaggctggtctcaaactcctgggctcaagcaacccatctgccttggccaaccaaagtgctgggattctaggtgtgaaccactgtgcccagccaatctctgtcttttaaatgagggtgtctgcatcgtttgtttcacatggttatttaggactaactctatcattctgctgctcagtagttttgtttgtccaggctgccctttgttctttttctgctttcttttgtattttatgatttgattttatttcctttgttggcttattaacaataacttttcgttttgttattttagtgactattttagggtttacagtatgcacctttaacatcacaatctatcttcaagtgacattataggcctcaaaccagaaacaaccaaaacatccatgaataggaaaatgaataaacaaactgtagtgtatcctcttaatggaatactacccagcccctgcccaaccccacaaaaatagaaatggactactaatacattagacaacatggacagctctcacattaattatgctgagtgaaagaagctagacaaaaaaagtataatgtattgatttcatttatataaaactctagaaaatgcaaactaatagaacaaaaaacagacggttgtgggggacgggacaggaaagaggaaggtattacaaaagatcatgagaagactttttggggtgatggttaaattcatgatgttgattgggataatggtttcacggatgtatatacatgttgaaatttccacactgtacaactgaaataaatgcagtttacgtcaagtatgcctcaatagagttgttaaataataaaagctgccttctgtcatcagtgttccctctgggtatcaggtgccatctcccccaggacacagtcttccctgacacactaaattctctgtgccttccacacgtggtgctctgtgaagatatactgtattactgtcctcatacatattagtcatgctgtgggcaagcatcatttagtgaatccattcaacataagaaacaaaatctcagtaaatgatggcaaacaagtctgagtgtgactttatccaaacaaacaaacaaaaatgccatgaaggtatttttcttttgctgtctggctctggagctatagcagctatcttgtgatcataggagataactcaacatgcagaagacgagagcaggaataaataaaagatgcccggtctaacagccttattcaactcccttatcaactctggactgtagagacaaacacagctttacttgctcaagccaccgctgagtctgctataacctgtggcaacaagcattcccacaagaggcaacataactggcagcgagaggtgatgctgagggactccccggcaagaggactggacggctggaagaagggatgagacagttttacttttcattgcatactctttgattccctttgaattctaggccacgtgaaaacattacttattataagtaaatgaataaaatgagtaacaataaatgaaataaaaatgaaagttcagctgttgttcaaatattcctctcttaagctgctgatcaaatattcctctctcttaaatatgaagattctgacaatgaatgctcatataacaagatttgtctgtgtacagaagcatcatttatttaggttcctgtgatacggatgatttaaaaaaaaaaaggactggattgacccagatatattaattgacatggccctatcttccccaaatagattaacttttaaatacaatttccccttcctttgggaagttttccatcttttacaagaaacaacacataactgctgttgtaattactgatgacggaacatttatttagtaaaaggcactatgtgactacgcttgtctgcaacatttcccctttggaagacgctgggccccaacacctcacgaactgtgtctaaacacctgcagcatttcccagcagatcactgtcacactggaagcaccaactcccgccaacaagggcatttctggccatgacaaaaaaaaacactggtttctgggttaacatgtatgtttggtgatgacacaatgtatgtctcatgataatcattttctttacaggttggctataattacaactataaccaactatctttcacctggatcgtctttgggattctggtgtgaatgcgatgtgcttttcctcccatatatcttcctcatcagagccaccatcatcaaactgttgtattctttccttacaacatgcttcaaacaaggcaatatttccctaaataaaaatgagaggaaaaaaacaacaaaataaatttaaagtcaagttatcttctcttaagcattaccaatgtaaattgcattttttcactgctttacaatatggtgcctatcacatacaccaaaataaaatataaacacctaacattagtttctgtgtccgtaacaagaattcccctaaaaaaagactgggtttccctaaaaagactagcaaaaagaagcatagaccatatcctctttcatctcatcaaagcatcattgtaatcccaggagcctcccctgtcctggagatgcggtcccaggtctgtcctagcaaggaaaagcaaccgtacttatttgcttttactagtccagctgagcagtgataaccttcaatggctcaaatcagcagttcctaccttactccatcagcaaataagccagtggtctctcatgctagtcaacataaaatcaataaactgtctccattcaggtgacacgactgtctcggtgtttccacagaaatgcctagtaacgaggggcttgccctgacccagtccacatttctctcctggcaatacaaaggagtcaaaggcagtgggttggtgtcaaactgcagccttctctttgaagtcaagtgtctacgctgcaatcacaagtgaccctggtcttattagctccaccaagtcataaaccagggctgcaaaaatcacatgcccacgggtgccaggtaggccgtgggacagagtgaagtatgtaacaccaatttaggattagggctctagagcacaggggtcccagcatgtggcatccacacagggactcacccaatttttaacctctcatgtgccacactgctcacaacagagtttatacttacactttcatttgtattgagagtaaagttgatgtctgatactcgatcaaaagaaacactgtaaaaaaacaaaataaaagtgtaggaagcattaattactatcagctcacagaaaccgtatttatgaaagtttccaaatttaagatatttacactatcatcaaaatctctataaataaaaaacaaacagaaacaaccttcttatattaaatgatgccagctcccttggtattaatgaatttatgtaggataggagggctgcaatagaagccttctgagacataaagcctttgggacacccttgaatccttcctataaaagatttttaacatctatggtaacaaccatagttccatgggccatactaatataaccaagaaaaaggttatttgcaaagaaccaagtcaaaacatgaagtatacaaaagctgtcagacacttgagttttctccagggatagtcaaactcatacacaaaatacatagacacccatgaaatcttatgctgttaacaagatatcatctagaaaagcaaggagggagtaaaagaattcattgcttattaaacataagtttgaagaggaggggctatcttatgattcttaaaatatttgttccactcaatcactagtccaagcatgcaatacagactgtaaagagattacagatcctaactaggaagatgaagcaagagtccaggcacgtgaatgtcgagacaccaaacagggacctgcagggtctggtgtgaggtggtggatcctagcctgagtagaatgctcctggggtatggacagaatatcttgtgttcttgctctttttgagttaaaatgagccaattctcaaggcacgtaacagccttcaactcttgctgtttacagcggcacctccattccactgtgcccatacggcatgtttatagcacaattaagagcgtgctgtaaaaatattttagcttctcacatactgcaaactgcaacctgtgacaaacaacaggctccactggctgtggttcaacaaattattgagaatttactgcttccaaagaccacagcagatactgggtgtctgtggcataaccgtgtctcctgtgagaatcatcatccaatattcaaataccagctgccttcattttttttcttaaactctgtgtcaatgagctataatatctacctcaaaatattttgtttataaatctcttctatcccaatgtcagatgctagaccacctgttttcatttctattaactacctacacattttctactcgttaattctgtacagtatcaataattctcatttctctgcttcttaccctgactgcaaaatgagtggttagtgtgtctggctcttgcaaaaaacccaaatctaccttctgatgagtcacctagagatgagaatacatgtagggcagagcttttcctgccaacctggtcatctgctggaacgtgatgccccagtcaacaacacagggattaataattttattattattattattgttattgttattattgagacagggtctccctgtgttgcccagggtggagtgcagtggtgcaatcctggctcactgcaacctctgcctcccaagttcaagtgattctcccacctcagcctcctcagaagttcggactacaggcacacaccacccagcctggctattgtttttgtatttttagtagagacagggttttgccacgttggccgggctggtctcgaacccctaacctcaagtgatccgcccggctcggcctcccaaagtgctgggattataggtgtgagccactatgccaggccaggattaaggactttatagataatactatttaacgttaagagctagaattaagaacagtgacttgaattcctaaaagtgtaatctaataacaataggcttctgtgaaagaggtcaaaccctataggtgaatgcttctttccttgcagtgattttttttttttttttaaagaccgagtcttggccaggcgcagtgactcacgcctgtaatcccagcactatgggaagccgaggcaggcggatcacgaggtcaggagattgagaccatggtgaaatcccgtctctactaaaaatacaacaaatcagccaggtgcggcggcgggtacctgtagtcccagctactaaggaggctgaggcaggagaatggcgtgaacccaggaggtggagcttgcagtgagccaagatagcgccactgcactccagccggggcaacagaatgagactctgtctccaaaaaaaagggaccacgtcatgctctgtcactgaggcaggagtacaatagcacatctcagctcactacaacctccgcctcctgagtagctgggattacaggtgcctgccaccacaactggctaattttttatatttttggtagagacggggtttcaccatgttggccaggctggtctcgaactcctgacctcaagtgatccgcctgcctcagccccccaaagtgctgggattacaggcatgagccaccgcacccggccactgcagtgttattttaagtcctaattatccagtcccagggccaatctgctggaactagaggaacaccgtggaaagagcaggttcctcccactcacgaatgctcaagactaagaatcccgcagaatcacacatacatctaccaagagcaagggtgtgcaagagcaacagcggaaacagaaaaacatactcacttgccaatgtcatcttgatctgcaaacttctcatcgttgaagccaaactggtcaataaaattggacgtcatttgttgcatctgataatcagaaaaggcctggcaaccccaggaccagtgacagtgatataatgattctaatgatattctacatactatttgcccatttgtgttccagaaatcatcttatttacatagccatagggctataaaagttggtgtgtttttctaaaagaaaaatcaaataatttcagacacaatttgccaaaaaaggaaacgtttgaaatttggtctacaaatcattctaatgcacatgtcactgtaagaaacactatgtgaccactctgtcctctattgtgaattatctttagagagaggtttggattaagcctagtttaaagtgatcacatgacatggaacagtctgaaattataaggtgtatcagtcacctctggacacaaccaactttatcctaagatccaacaagtggtgaccaccccctccctccttgccacctcctccacccccaatctactacagcaaaatcacaccagaggaaaaccgactgatgaacacaagcataatcctagaaacaaaatgttcagggacatttcatttctttttttaaaaaaattaagtcttagaggctgggaagaatataaaacgaaaataatttctaccctacctaccttatgaagagagtaaacgtttgactatttatccaaaatcactctgaaaagtctctaacactagaagacccacagaggagccagttctgtttccttaacaccaaatctagagagtaccagacttgttcgggtttttagttgaaaatgtgggggggggggggtgttataatggaccccaggaaaatgttgatattctaatttaaaacaagcaggcccaaagaagcaagtgaaatcagcaagtatgttcttacgtattaatcaggagtaaagaacatatgaagacaaactagtgccacctcctcattctaacccaaacaataaatacagtgaccagagctgcatacagatgagactgccgttttctgtgggtgagcccatgaggggcagggaggcggctgttggctcaactgaaggcatcactcccactggcatttgctgggaaggaggcagctgtaactgtattaaaccaccttctccttggttccacatatgggcagagcctccagattccaccttgcagatgtacactgcagaaatgcctctaccattaattcctgattactcattctggtggcagggaattatggcatggataattattgcagataatttaaaaataaaccttatattaggctttggaaggtatctatactgcttaggtctgaagaaaagctctatatgtctagtttgactagacagagagaacccaaaacctcccttgtcgctcatgcaagacaacagcacacccactgcccctctgctcactcccacttttgtgctgccccctttcttgcccccagaggtgatattagatgagcacatgggggcagggagcagggggcagcaagcgactggctgtggaatggccacttggtaaggcatggagtgtaaaccaaggctgagcacgggggtctggctgaaagcagaagggtagggacaagtcctgggctgctgagctgagttctggacctatgaatggacaatgacagccagcattaatattaattacatcaaaaagaaatcagttcttctgaactgcagctttatcttttatgaggcaaaacagatgctcagtacctcaaagatctggtaaagaaccatgaagtgattctgttgagtaagcagcatgaaccacgctctgagtttatctacagatcagaaatgtggtcacgtgagggaaaagttccctcccaattgttttatttttcccctccaaaaaaaaattttttttaagagacagggtcttgccatgttgtccaggctagactcaaactcctagactcctacctcctagtaatcctcctacctcagcctccagagcagccagactacaggtgcatgccatcgcagccagctctctcaaaactgttatacctctagtgatcctaatgtgattctcctgggtgtaaaggggaagaaatattccccaaaatgttgttatattttaaatgcttcaaaaatagaatgcaaatactaaatatgaatgtatacatacatacatgtacatacagaatacatatacagatatatatttatctattcatccatctggagagatacatagcaactgacacagacactagtaacttccatgcaataatgcacagaaaaaaggaaaatgatcagatgtaatcctcattagttctaagtcaattacagcttctagcaaagaacttcacatttcaaatctcatttttactaataaagctaccaaaacttacaaatatatgtaagtgaagactgttattgtatcctatttaaaggtatataaaaagtgctttgaactctgagaaacctatatctggaaagcacaatatagctgtataattatttttaaaaagcacactttcctagtactgtcatcctggccaaagtcagaaactgttcaagtcactgagaagtgagccaaccactttaagcaaatctcttaacagtaatgccacccaggcaacagaaactactggtcaactaaatgtggcctaattgcctaccagcaagcccgtatgtgatgtgaggtagtgggaaatgatgagtcagtgtttcagagcccatatgcggcagtcagtctgaattctccagacctccatgggggcctcaccctccaaactctataaggcagaatcagggaggtggggagtcaaacaccagactttaggagaccagacaaggctaaagggagaagcaaatgggcagggcacaaacgcctggaggcactccccactggtgacgtggctgggttacctggttaaattatctgccctgagctctctacattcggggactttatcaacatgatgcccaacctcaaacgtgaatgagaacttgaagttcaagtctacaaactaatattctgatcttaatggaggctatgatgaaactctaataaattaaccaagaccttttttgcattctcaaaattttaagaagtgctttggagtgtatttattttcaaaatgatccatgattggtttaaacatgcaaagaaaaatgtactggaagcttgtcaatcagaaaagagtaattattcttccactttgaaaagttcatatgaagtgggtaaattctgcaagctaagagcttggcaagggctgttgtaagttagttttgtgaatgaaatggcttcgtacgcacgtgagctgtcggtcaaacaaacaaaataatgtaagaaaactctccccagaacaggtatgaccctggaaccagatatcatgagaaataaaggaatccactttccaaatgcctaaatttaaccaaatctagactaaattgacagccgaagttccaagtttatcattattactagtaaggtgttctttttcttaaagctgtatttcaacaggtacaaaattaccttgataatttacatttgatatcatcaagcttcattctaggggtggaccaatgtacagcactcaggttcatggccaactgggtggactatttcagtactctacaggtgcctcagtggagggagagcccattgtccaggtgcttcctgggacaataccagagcgctctgggaaaagggctgcttgcaggcacgagggctcacaatgagccatggtgggccaccgccacggcccgtgcagcctaatagcaagccaaggcaggaagctgtgagagctgctcaacagtgccccctagggactggctacttcctgaccctaacctccggaaatctgctgtcaaaggcagaagtgtcaagaatcaacagagaagtcagccaaatgctgaaatgctacttcagacctatttgggaaaggtaaactctaaactgtctgagtattaaaatcaaacaattgcttagctcaaccaatactggaatatgacaggtgtaagacttacaagccaaaagacagggccagcataagcatgtgaagcttcatctaagacgaagcttagagactaaaaaaaagaagccaagcaacaacattctgtgctgggtgggaaggtgtccccgttaattctattgctgcaccaaagcaacatgtaagccaaggcattctggtcctggctaaggacaacttctccatatgaaaagctgatagcctgcaaaagggcttctgtttttcactcccatacctagtagagaagtgaaatcatttgtcacttctccaagaactaacaatggatgataaatcagtacatttattattcatatcgaggctttcccccacaaagattataagcaggtggtaaagggagatgataaattcaggggcaggcagagaggggttgcaatgaattacttcaactaaaaatttactttagatgtaactataatagaacttacatcaggggtattcgtgagagtttacttttacttacattttaaacgtcttatttctattatttttaccagcagatctctactacacaaatctttaagcaacaactcaactattgtaaaggtctgtgtaacaagcatgtgtgagatgccttcttaactattcagttcattcaaatcttctgaaaatgtacttgactcatcactgttatcagggatggaacaatcccttgaaacataaccaatacaaatctatctttcatttacccagcacttcctattttaaatgctttggtctaactaataagtaaccccaaatcacattctaatacataatctgactctgaagctgattcataaaaggcaactaaactaagcatttaaaataaaaacaaaaagcaaagctttaggcgtgactcacttgctgcaaagaagaatcctgtgagaaacccgtttctttaaagtcaatttcatcatcactggatgaatgaatatggcaggttgtaacctatatgcataaaaatgtaaaagactatttaacatagaaaagttttggacatttgtatcagcatttttatggaaaaatcacatttagtttttttctcaacgtgtaacagaaaaaaatgaaagtcagtcacagttaagctgccaaacccgcccaatgtgtcaagggcacccttccttccctcgggccaggctgctgccctgccactcccttctagttattccactcctcactactgacatcgccagaaaacagacaagaagaaaggtgagttactccatttaagtgattttgataatcacctccaattaaatgtttacaaaaagaaagacagaggtaatggcacagatgaaacacagaaaccctttctatgtacggggcctgcagggtccaactgcaatccccagggattaccagtgcgccagtgcgccactcaaaaggtcaggtttaaatataaccatttcaaattcttggacttcctgcccacactaagaaaaccactgtctagtagtactaaatgtgacttgagtcgacagcttcccactcacaaaagaccccaaatcatctacccttgaaaatgtgcaccctgcccccagaacttacaaccaactttcagtaattaagcaaaaacacaaacatgaactgctcaccaattcatcgttaagtgatttttattaattacaaatgtcacacaatatttgggggaagcattaacaattagaaatcagataaacaaataattaagtacagcactaatagtagtgattgctatatggcaagggataaacatggacagtttgtaaacttctagaaagaagtactatatttctgcgggtaacttacactgtattctctgagctgtttattctgtacttttcacagaagtgttttgggcagggaatgtcatcttagggaagacacgggctgctgctacctgccaactcatgaggctgtacctaactggcctggtctgttttgcgaagttgttccaacactggttcaataaacccacagtagaattcaaataggtctgtatagggtatgtcttgtaaaattctgagcaaatcactgcctgaacaagatgaatctcccttcctttccccaaccatctttggtaaagacaccaagcctggatgaaattaagctgtgataacccagtgtttccagttatttcactctccatcctctcaaaggtatagataaagcactcccattctgtttgtgaatctggcctgatgaaatcaaaggtagattccgtgatcaaggaacggcacctgcttgagtcaagagtggctttagtgagttactgggtaaagatgtgggcatggggatgttccaggaaagccttgccagagtgtagaggaggagtgggaatactgcttggtcatggcagctggcatctcacaggactatgttaaagagcaagtcaagtggttgtactgcagtgcactcaagaggagcttcgggccacttggctggcaagccagcacacatatcatgctgggccagtgtgttttaggggtgtaaccccatggtggggcacagaaatagaaggccatgcaaagaactgagcaaaataggacaaaacagagttggcgactcttagccaagtcttgctgtctaagttaaaataggattcgatgtatcctcattcacactttcgctttttcctacaaaataagattttaacactctttaattaaagatgagaaagaaactaacttttattgaactactatgtgccagacattgtgacctccccttcgcatgttctacttaaactggatcctcaaagcaatactagaagatatttaaaaaagctttctccaaaatgaaactagttttagcaacttattagtaacacaatgcacacacatcttcataattacattaatggaagatgtgagtctgattctacctacaccatctgagtctgaaatcattaacaaaatgagctaaaaagatgatctacctaggctgggcgcagtggctcacgcctgcaatcccagcactttgggaggccgaggcgggcggatcacgaggtcaggagatcgagaccatcctggctaacatggtgaaaccccgtctctactaaaaatacaaaaaattagccgggcacggtggcgggtgcctgtagtcccagctactcaggaggctgaggcaggagaatggtgtgaacccaggaggcggagcttgcagtgagccgagatcgtgccactgcactccagcctgggtgacagagcaagactctgtctcaaaaaaaaaaaaaaaaaaaaaaaaaaaaagattatttacccatgggggaaacttgctaatcagaatcccattggttcattattcagatgtatacaaaactgaattcctgatctacacttccaaacacactccttttgaggcatcttcagctcagtcactgccaccttcactcttcttcaactagaaacctcggtcatcttgtttcctccagcccacccaccatgtccactctaccttcaaaatggagccaaaatccctctccagacccatcgcccttcaccaagtctgttatcagctccccagtgcaagccagcactcccctcacctggactaatgtcacagctggcagttccccagtctccctcctcctagcccttgccccacctagcagtctgttctcaacccaatagccacagccatcttttaaaaatatacatcaaggtatggcactttttagttcaaaacctaacaaattctcattagatcaaaattaccatagactaaaaagctgtagaaaatctggctgtttggcgcctttctggcctcaagtccttctgttctctcctttgcttactgttacatccacacgggacaacatgcaagtccctgcacacactaggaacaacccaaattcgagtcctctgcattttgctcttccctctccactccacaaatgcaccttcccagtgagattttccttgacaccagattttaaactgtacacctgccccaaagactccctaactccctcccatgcgttggctccttagcacttaccatctgaaacacgcgcagtcatgcattgtttcatgacaaggatacattgtgacaaaggcaattctgtcatcatgcgaacatcatagagttcacatggtagagcctactgcagacctgggctatctgctacaaccaattgctcctaggctacacacctgcacagcacagtactgcactgaatactgaggcaactggagcatggtgataagtatttgtgtatctacaaataaaaaacgtgcagtaaaatcgagtattctaatcttatgggactactgtcatatatgcggtctattgctgaccgaaacattatgcagtgcatgactgtatattacacatattgtgtgtgcacacgtgtctcttactcatttgtttatccatctccactgaagcagaaatttttgccaatcttgtctagtactgtatcttcagtgtctggcacattgtaggcactcaaatatttactgaattaatgaatactaataatcactgaatataaacaaatacagcaaaaagcaacaagtatataacactcttgccaagctagatataccgtaagtaaagtgcactcttgttgtagtgcacacagtttcggagatattatcttctttcgaaataaaattttcgttttgttaactgttgttacaggaaaaagcaaattggtgtttactttggatgattaggttcccaagggaaatcagaagtgtgaaatgactgttaaactctgaggcccgtattagtgacaagtgaaagctagagacttattccttgatcctcaaagtatggtcccactgaggacccccagcatcaacataacctaggattagttagaaacacccactttcaggtttcaccccaacctgcggaaactcctggtgattaatacaggcacacattcagatcattctacatctcttcttctacacactgtcttgtcaatgatgggaaagaagcatcaacaattttaaatacattttcccccttggagaagagggcaaaaaatgaaacaaactcaaatttttcaaagtcagtacaaaaacatgtcctatgttctctaaattcactctacctaaatccttgccaatttttagtttggggacttggtcaaaacacagaggtctttggatataattaaaacaccaacttttgttcatcataaactccaaacataaaaacacagggagtatatgaatctgctgtgcacgtatttgggtatgatggagccaaaagattaaagcacttcgagtatctcagagagaatttaactaaaatgttacagaagtgataggagcctggggctgggcacagcttatccaaaagaagtgagcaagtcctcaggtacacagccaataggacaggaaagtgttcagtgtataaatgaatgtatccttgctgtaaacagaaaaataacatgtcaggttaacaatgcactaacttaagcacgtggtgctgaactgggctgactccacttctatgaatatacctgaaatgacttccagagaggtagccaagctattctaaaatcaaggaagtcaaggcagtgtatctaatcttatctatttgggaaagggaacagggcataagcaagctattatttaactaccaattccagtgacaagcatgttaagaaggcaagtgtaactaccacatttcaaacatgggcactctttttctatgtcacttttgcaagggtaaggcccactgcatttaccaagttgtgtttataataatatttacaattgcgtattttcctgaaacatggtacccaaccccactgagatacagcttgaacacattctggacaggaaaatgaatggcctggaggatacgattaaaatctccttggtgcctagacctactatataagcatattaaacacttggaatagctgtagccctcacaatactacaaagcaaaactccctatcagaaggacttaagactaaacggaagtggtatttaagaaagggctcgggaataaagaattgaagaagtatttagatccacctgaaagtctcaacagacagcaaaattctggagtggggctaactcaacaggggatataggtaatgttaaagggccctatcaatctaaccacttttgctttataagccaacttatgattttgtttgactttagattatgcagtccgagtatgatggcagaaaagcagagcaagcaaagaagaaccgagacgcaatctgagtgacagatggagcccaaaataatttttttctaacacagtctaccaggggctgaacgttttatttttgcgggatgaccacacccttctatggggatatatgtagtaacatttacacacaatcccagagcagatctgctgacagcatactatacagtaagtgagcattatctgaattgtaatgaagtccttctttattacagaactgctcacaaaagaaatatgcttgagttacctaagataaaaacaattgtttaaaagtctggtaacaagcttaattggacatttttgacttctaacttttaagccaatcaaaggataattttaaaagaagtttcccaaacaaaatcagattactaaatattcctttataagacaagacaatagtccccttaaaagagactatattgcctgcaaaggaatcaacgtgggaacctccaaaattaagcagtatgatttaacagtatgggagaggacaattccattctacaaaaaaaaccctgattatccagaacactcaagttaaacgatagtccgagtatctatctacaatgggtaaaatattcattaaaaatgacttaacccttccttgatgacccagggctgtcaatactaatgtcattttctctgctgggctgtggtacacagagacactcgggctattaggccttaggtctattttaattaaatggccccacatagcttccttttaatagttacctcaacttcataattcttccaactcttaatacttcctaattctatcattattccccgcttaaaaagtgtgactctgtcaggagtctggaaaaagatgaccatatttttaggcaatctacaaagtagggggcacagccctccagggagtgacacaggaggaccaagtggctgctctctggctttcagagcctgcttccctgttgcttcaggctgccagatcattgaattcctaacagtcaaggtgttactgcatattagaaattcaagactgccactgccaaatttgaaatatagaattaaacgccaaacataaacacttcaatgtcgagtcacgtgctgcttctgtctaagcaaaggccacccctcgactatcagctggcatgtacttgtaaaaggaaatgctttccccatctttaaaagcagaaaaaagcaatacttaccttaaaacttaaatgtgtttaaaaaccaaaaaatacattccaaagtccaatataatttttaaaaaaattatcaatgccattattccctggctcaaagtcccaattctggtaaaaaaattttaaagctggggtttcaaagtcatctacaaaatattcccccattgggaatgatgtaaaacgagggtatactcaactcaataatatcagaaaaatatccaactgaatctttcgctttcctaagcacccagggttatcagtggcatgtggccacaaacccagcagaatgaaaggaaggcaagaggctgttgaggtgctcggcagcagggcatggagggaaatggacactaagtaggatgtggagcagaaatcagtgacttctcaatatccttctgtcatcccaggcaggtaattaggagtggactagacaaatgggcaagaatattgtgaatactgacctctctccctggtaaagagataagaatttatctttggctcacagttactgaggtaaatggaagatcttttacatctttctgaataaatgggcaaaggctaagagcactgaaagaataaaaatgtaaccttgtaaaacctactagatctaccgtgttcctcttgttagtttctcctaaggagcttgtgcagaacgtctcccatcgttccctgacttcgtcgggaagatcttcagagtgagaaaagcaaaaaagcattatcaccacaatgacctccacggagacaaataaagtaagcaggtaatataaaagtgggcctactcacctggttcatcaatggtgagcaggccctatcagctgagaaactgggtgacagccagcccagtgctcttagagaaatggaattattaaaccttccataggcccaaatcccatggactttcaggaaccagaatccccctacccaatggtataggcttgatgaggccaagagccctaaggtagcttgtgaacttaacaagtttctgaaaatgctctggtagaagcttaacctggaaagtgtgtttccaacaagcttttctgagaaaggtggtaggtgtttaacgtgtcgggggtagggggatctttttccatggtcaagttaagtctagaaaatgctgcaaatgacagctcctgcacactttcttgaaatgctctcattggcagctggccaatgaatgttccacagaacctagtatggcttttcaaattgctctaagatcatgtttcctaaatatttgtgtcatgggccaacgtggatacacaggtaatagtgaaattctaccttctagagaaatgttaaagaaaaggataaacaactgcttttctgagaaaatcaaaccatgacgtaattttagaggcctaactagtcatctgataattctggtttaaaacagccatgcatgtgtgcacactcacagaagtgtacacatgtaccacctggcaagcagcttccataaaggaaagtctgatctaaaaactcagtcatatcacatggccatttcttcttagttaggacataaagataaactgtgtggtgaaatggcccaaggaagaggcttatacctcttatgcctctctcaagaagcaaaattagaagtgggcacacaccactttttccatccctggtgacaactgtggttttagtgcacattcaacagggaatagcctcttgaacaaacaaacattcttaagaaaaaatggaagacccactgggaaatgattttaactgaacaaattctgtaccatggatgttaaagactgttcacattcagaataggtctcaggattggtaatcctgttggtacaaaaacccagagtacacagttctctcattttagaagaaggctcatggcttggggccagtgtaaaaaagcatccatatagtttcttccaaataagcttgggctgattaaactgaaatgctatacagaaagagtcctttagaagccaatacccctcattttagtgacagcgacatcaaagaaatgctgataaatgccctaatattccagttaaagaaacttaattcagaggctatatagaggccttcagaaaataaaaggcaaaattatagctgaagtggctcaactgctagcatatgagtacttcacactcacaatactcaaaagcatgattcaccaagcaatgctctttaagaatgacaataggtgactcttatatgctgaatccagccaagcctgccaatgcttatggaatggtctgtaactacatgaacataaatacaaccaaaaaacaacactgttcaaacacattctcaagaacctcattcaaatacataatttgccaaatataaagaagtcccacaaatcactattaaaaatgctacatgcatttctacttgacccttaaatccttcctgcaacccaacaaaaatgtaattcaaatttcacaaataacttacctttgataagctgctgcactaatgcactgttggggcccttgtcagtgctgtgcacgatacagttagctatcctcgttaggtgtcccatgtaaccatgccgtcttcctccctcagccctgacaagaggtaaaggacaaatactcagattcctgataggatgaagtgatgaaacactcggtaaatactgcggacttttaaacaatcattttaaaccctgaaggcactgaagaaaatgacgatggacagaaaagaaaagaaaaacaaaggaatggaaggtgccagaatatgaccatgcagcatggtcagggaggggtgtgaaattgtaaaagattatatggcagcctcagtcaacaggccacagtttattcgaatctcaaaaatcatcactcactgtcaataacacattattttttaaaagatcaaataaaccttctctgatgcctaatgttattgtgattttattttacatctttttaatgaaactttttcaaaccttaatcagattataaggaactgaggtaagaattctgctggttcattttcttaaaagatagcaaatttttattatatcaatgaatagaaataattatctaccaatgacatgtctcaagttaagatattagctgatgtgagacttggccaagataggagacagtcaactagtacttgaccatacaccattctgaacacatgcaaacaaacagtctttgtccttttcccatttaaggtctcatcttcccaaccatgatcaatctttacacttaattcgtatcaggccaggcacagtggctcacgcctgtaatcccaacactttgggaggccaacacaggtggatcacttgaggtcaggagtttgagaccatcctgggcaacatggcaaaaccccatctctactaaaaatacaaaaattagccaggcgtggtggtgcacacttgaaatcctagctactcaggaggctgaggcaggaaaatttcttgaacccggtaggcagagactgcagtgagccaggattgtgctactgcactccaacctgggtgacaaaataagactccgtctcaaaaaaaaaaaaattatatatatatatatatatatatatatatatatatatataaaataagtaaactcatattaatctgatttctctacctatttacaaagtgccaagattttaagctctatcaaacgaaagatttttgactgcagatagcagggaacaaacactgcagagatttttgcttagagagagaaaagcctttcaggagcaataagaaaaaaaaaacatcctatgcttgaaggcttgcttggaaaataaagtatctgctagagaatcttagagggcttgggggtgcctaagggtaagaaagtacagggttgattatttaggtagagacaaggtcttgcttgtcatccaggctggagtgcagtggtgcaatcacagctcattgcagcttcaaactcctgggctcaggcaattctctcacttcggcctcttgagtagctgggactataggcaagtaccaccacatccggctaattttttgtagagccaggatctccctatgttgtccagactggtctcgaacccctggcctcaaccaatcctcccatctcagcctcccaaagcagtgggattacaggcatctcccaccgtgcctggccagagtcaatcttcactgagttgctcagagtctcttttagttcttcagtaagatccagagagccaggtgttacctacaggcaactgagtcactcttctgcacaccctcaagtacacaagtgaaagaaaacaaaggcccatctctaaggtgacccacagcttcaaactgcttcaggctgttgtgcaaggaaacaaggaaagttctttcgggatccccctagacagagggaatggtattcaccaggcctccagaaaacgggactcaccaggagagcagggcacaaaggatatctgagccctggccagatgaggaggcagcaagaagactggaggttgggaaggacacagagaagccaagacggagtcagacatataaccagagatgtcaactgggccacaaacagcatctccaaagagctccatttggaagaatgtatctgaggtctaccaatactagccccttgccacaaacaaacaaacaaaatgccaatttcccacatgaagccaaatcaaaaccctagtagcagtgcttattaaacgatttaaaaaaaaaaaatcaaacctcacaaagtaaggctgactcccaagagtcatctagctttcctggagacacagagacacataacaagaatgctgggaaatgatcaactacaaaggaccatgagagaaattttgggggtgacagaaatgtcttgattgtggtgatggtgacttcaggcatcagtcagaattcctaggaatgtacacctaaaatgagctttaccatatgagaattatatctcaataaacctgtcttaaaaacaaacacagaagcatgccttcagagtgtttcccaaacacgcccttatgccaccatgcttcagaatctacggggtgacataaaggctcccagggcactagagaggaatgctgttacagacaacacctgtaagaaaacgttttgtgtaacaaagctacttacatgtatcaactaatacttcacataaccttgccaatcagctaacaaacattttctaaaaagaaaacactgagcaatttttttcctctaggtccctgtacaaagcaactcttctctacaatgaaaatatgtacgtgataccttctgttctgagcataaggtgaccaggacaaatacactaagtcacatcatcaaggacttaactttaaccttataactcttagaacagtagccattcaaaaaggaccaggaagtttcaaaggcagcacagaggtggggaacactccgaactcacttgttttgccccaaaaacaagaggacctaacaagaaattattagtattataaaaacaactgttacaatgaaataatctggggaaaagtttaaattgtaaaatggccagtatcatgtaattatttccatttttttctgactagggcaaggaggtattattttcctcatattaccaaccaaactgaattcctttcaaaaaaacaatttacttactgtttcttctcattcatttcccaggcttcaagtattcgttctattaattgacatttttggaaaagctgaaaaaaaaaaaaagaatattccagttaatacttcaaagcatcaaaactttaaagtgaaacagaactctaggttaaagagaatagtagtatgcataatctagcaagctaaatgttactaagccaaatgcaatgtgatcatcaatctactgcagacacccacaacactacagagattcaaatcaggatccacaccctccacagaacatctacaggaaactcagtattataggtagtgcagttaactacctatagttaactataaaggaaagccaggttttattagctgtgaaaattcagaacagaaatataaaacctgagctaaattaaaatggaataaagaaaactatgccttggcaaaaatttaacttagaatccaaagtaatgcttgtacttttaaaatgtgagcacgtcttacttccagatgaactaacattactgcattaatattaaaaacaggtgggttttgcccaaagtctgcaagtcagtgacaactgctgtaggctgcaatactggaatgtgcagggctagttcttctcaggtgtcatttgtctttcccatcaacttggctgttccaagctagccttttctacattttaggtttgcgagtaaaccaagtgtgggctagaaattttaaaagtaccatagaactaccaagcaagaaaaaatctgaagactgacttagtaaaattatctcatatttgacagaagagaaaaagagaccccaggaagactctcaacatcacaaagaactcagttctcctgactttcagtcacgtattcagcaaagaaactacactctggtcagccaaataatagtgcaaatgttttccatagtatttacatttctatgattcttcaaatcatcaaagaatttatatatcttcaaacctattaattttaccaaataaggaggccacttagcttttttcttacaagactgttcatttaatagttatttgtccagtacttgatttatataatgatttatatgttaaaagtgaaacgaacacatgattgtcaaatatttagactctgaaatctaacctcaagccctttaaacctcaattcacatcacagtcaagtggaaaactgctataaccaggagagagtgggagaaaaacgagaccaaataagcttacatgttttaataacaaattatcaccagtggagtcttgatcggtaattgtggcattttctgtgttttcaaaaggacttgcaagaatcagtgcaatacaaatttccacttgtgtatgcaaaaagttattccatgtatacttgaagaacatgttctacaaaaaagaaaaaccatgttttattcggttacctcaatgtttaagccaatacttaaatacatttacagaacagtgatttaataaagtaaaaatgatgtgctctcagtccaaaaggaccaattaaaaggaacctgagttcacattagtacttgcataaccacagtttcattttctgtggtttcagttacccacagtcaaccatgatctgaaaataggtgagtataatacagtaagacatgctaatccaagagatgacattcacataacattcattacagtatagatttataattgttctactttattattagttattattaatctcttcctgtgcttaatttataaattaaactttgtcacaggtatgtataggaaaaacacatagtatatatagggttcgatagctgtggtttcaggcatccaaaggagtcttggaaggtatccctcataaataacgaggactaaatggggatgtgaagtattgctttagagcctaaatggcgtgctatctgcttatctgacatgccagaactggtatggaatctagtaaaaaaccaacaacaaacatacaaagacaagagtacgtttctccaagagaaagggagtatcttttttctcttcaaagcaactaacacaaatagttagcgtggtaaattttctataattttcaaaaaaatttataagaaggcaggcgtggtggctcatgcctgtaatctctgcactctgggaggccgaagcgggcggatcacgaggtcaggagaatcagaacatcccaaccccggtgaaaccccgtctctactaaaaatacaaaaaaatcgctgggtgtggtggcgggcgcctgtggccccagctactcaggaggctgaggcaggagaatggcgtgaacccaggaggcggagcttgcagtgagccaagatcactgcactccagcctgggcgactgagccagactccatctcaaaaaaaaaaaaaaattgtaagaatttcattttgatgcaacaaatatttactgatggtttttgtgcagggtattgtatgagatgcaacatggcagacagagatacacaaaaatacggtccacagtcttgaggtgctcatgactcaactccagcatacaaaaactagagctatcagcaaaaacaaatgaggatacgagaggcagtaacgtgaatctcctggaagtacaagggttttcaaattacttgaaaaggtaatagcattacaaaagggaaagaatttctaaaagtacaaaatgccatattttggaagtcaatttagtatgtcatatttaggaaatggttgggtctggttatctaatctcaaaatgaagaagtaatgagtaactcctccagtagtctcatcaaatttagtctcatcagaagtagtcctaaagattaacagaataaattaacaataactgtatattgttattagtaaaattaaagaccagtgatcaatgacttaggaacgttatattcccggagttttatacactagaaggtaggacaaaaactacgtccccagaaggcaatgaccatgctagctatcaaagaaactgtaattctttaaatcttcatctctttttccaaattgctcctgttttctgtgctctatactgatttaacccaaagctgaaacctaacaaaaatatctcggtgacgctaggaagcacaatgatgtggttgataaagcacgtatgggtttgaaattgggtgaattcaaatcttggcttcaccgctcactagccatggaatgtatcctctctctgggcatgatctgaaaaacacatcctctctctcactgtaatgttcacccgagggtcctggagatcacccaggatcacatgaatagtgtacataagatgaacattacaatgcctgtcatacagtgaacaaacacctcctttgaaacacccccacatctcccccaaatatatgatgtgaccagatgtcttgtgaaacctgctaaagtgttaaccctcgcgctttctgtgctgtgggtggcagcacacagagaagaagcatgggctccagagctgggcctatggattctaagcacagactctgaaactggggaattcaggggtcagggagacctaaatcatccctgggcttttccttctccttccatcagtaagcaggctaataactgtgtctcaaggaagagtcaatccagactcaaatcaattaagaccatatggcgtcaggtacgttatacagatacctcccagtggcaagaagataaaggtttgtcccctcactaaatatgaacagaaaacaatgctgcacccagcagtcattgtccacgagacggagcacgagggaaaagccgatgtctcttaatcatcttcaaaatcctatgttacaattctttatataaagcaacagtagatgcctagtgaacaattataagcattcgaaatttataataaactcaaggcaaaaactacataaaacaccatttatgctcagaccaagaaaagtcactgacataatgtaaatttgtaaggttgtaacttggttaaatatccatgaaatatcaatggcaaattaaaatgtctgtgagcagggaaaatctcaccaatatgactccaatgctattcagctccataaggtccccatttatactgctggtattggtttgaagcaggctggatatcaacctaatgacattcaaccgggtattccccacaggaggatccagcacaccccatgtggtcttcatcacacttttctgaagaagaaaaagctttccaattaaattcagttaaatgaacaaagcaaatggtgtatttgctaagacatgacactagtttaaaccctgcaaacaacatggcctgaattttacacctgaaacaacatctaaagctgctcttgatatctttaagatacaatgaaataaccaagcaggaaaaaggaaaaaaaagcaaggaatttccctggatcataaattttataagaaatcaagtgtctccctgcctcaacattccaagctgttatgagaagaaagcagaaggctacagaatatcctaggaaaaagtacaatatttcaaaatctgaccagaaatctaaactaaaagaagttatggccgggcacagtagctcatgcctataatcccagcactttgagaggccgaggtgggtggatcgcttgaacccaggagtttgagaccagcctgggcaatatggtgagaccctgtctctacaaaaaatacaaaaattagccaggcatggtgatgcacacctgtagtaccagttactcaggaagatgaggtgggagaatcacctgggcctgcggaagttgaggctgcagtgagctgtgattgtgccattgtactccagcctgagcaagagtgagacactgtctcaaaaaaacaaaaaaaggaagaaggaagaaaaaaggaggaggaggaggaggaaagagaaggaggaaggaggaggaggaaggaagaataaagaagaagaagaagtggtagtagtagcaacagcagcagcagcagcagcagcacccgtggtggtggtggtggtaataattgctacaagtggttttggaatacaatcctcagtctgagccaaatctgtgataaaaatgcaaattcagacgttgcctctggatcacaaacctgaaatgtgatcaatctaaacctgttcttgtccatcaacaggagtttctatagcctgaaatcacaaaagtagaagcagaacatttcctaactttagaagtctgagaggcaagggtggcacgtaacagcctagggcaggctgccctttctgcccctccccatccacatcagtagcctcactccctctggctcccatcctcccgaggactcacagagctgtaaggcccacagttctgctctctatggaaaacagctctaattggcaggctttgtaaaaaacttcatggatctacttacagacacatcatacagtaaaaccaggtgcaaacggtactccgagacagacatatcatacagtaaaaccaggtgcaaacggaactcactcagttctcggagtaacagagaagtccaaacaagacactgccttacttttgaatcggggcccagaaccagatgccacctgtttgtccacccagaaagaagatgggtgggccacctaagacacaggtcaggcccttcctcacacaccttcttccctgtcagatccttctcccacctccgtcttccacttgtgatgttctctcctcttctaaatcttttctttttctttccttactctgtttttcttcccaggactggcatgaaggatgccactgaccatcattgtcaaacaccaacagaggcactttccctaagggcaagcaccaacactatggtccacatccaacacaggctgaatgcagataagatgtggctggaatggaaccagcagagtaacgcaaactgtgagcacagtgatggaaccacgacctgctcaccaatggcatcaggtatctgaaaagatgatctggagctgaactagactcccttggttatataagttatcctgtgctcccccaactccaaatagttaaataaacagaaaacatctaatttacaagtgagaaactagtattctaaattcccaataactcgcacagtagataaccaccgagatacaccagattcaatgatatagggcaggaaaaaaaaggaaacttaagaactgttgctgggaacagaactcacatggaactgaatcttccaccctagactccaaaagcaagtgattatcaccctaatctaaatctgtatcaatccaaggggcgaaagaacaccatttatagactgctgacaaaactcttgtgggtcttcactgaggaaacagtcatttaaaattagcacatgggaggctctgtactgaaaaacccccaaatcatattctctccaaattgtatactaacttcaacctactctttcttaaataaggtcgactatacatcagacatacactgctccaactctgagtaagaaaacataatttcaaagatccgtttctgaaagattagcttttcctgaaacattcaaaaataatatgctacaagaagaaaattcttttttctttactggcatgtaagtacccaagaatttacagaagaatgaaaaggtaaacttcctaaactatgaatattttgtttaattctccattctccactcaaaagcagtaaaaatcactggcagtgttatcttttcactcattttgtacatgcagaccacagccagttctgccactcctaaggcccgtacacattcgaatgactgtttcaaccaaattactcgctgggcagccatgcttaacatagctcccctaccttgggtggctccagcaggagttcatgaaaagatccaagtcttcctctgatggcttctagaacactcttgtttactgaacaagctgaatggctcatgcctggtgggcagatctctatatggccttcaaatcttgaaacaaagcaaggaattttagttattataatttcagaacaaatcattcaagcttgcatgcctgcaggtcgactctagaggatccccgggtaccgagctcgaattcgccctatagtgagtcgtattacaat

SEQ ID NO: 18 - DNA, 52156 bp, Homo sapiens
  unsure (12748), (51260), (51261), (51264), (51265): Identity of nucleotide sequences at the above locations are unknown.
ggcgaagaagcgagaaggggaagaagatatgaggacagaaaggtcagaaggcaaccaaagtaaagataagagaaaacgcagagaggaagatagaagaggagcgacagggagagataagggaggggatggaagaaaataaaataaggtaagaggtgagatgagacgagaccaaacggaagtaggagaaaagagaggagagaaagaggcacatgagaagaaacaaaggaagaaacagaatgatggaagatagaagagaaagaacacgagagttatgaagagaaacagtaaaatagtggagggacaggtgtaaggaagaagaggaatgaagacgagagaagaaggaggagaaaatcgaaagaagagaataagaaagaaatgagaggaataagaaagcgagaggaaagaaaagagaaaaagaggaagaagaaatacggtgaaagaagagataaaaaagaaggagagagaagagagggagatagacaagaaaaaaggaagaggagggaacgagaaaaaggggagagaagaagaaaacagcaaaagaatgaaaaggagagaaaaagtagggaagaaagaaagaagaagagatagacgttcagaatggcaaaagaaaaaaggcgaaaacttagaaaccaggtatgaatagaaaaaccaaggaagaagaagagagggcgtgagcctccctaatcccagctactcagaaggcagaggaaggagagtcgctggaacctgggaggcagaggttgcagtgagccaagattgtgccaatgcactccagcctgggcaacaaagcaagactccatctcaaaaaaaaaaaaaaaaaaattaaaatttggcagctctgagtctgttcccaaaatttaagtcatgatagccaggtgatgggtgcttgagcatgcagcctgctcttctctctgcttttgaatatgtttgaaactattcagttacatgtgtgtttttttaataatttgttattaatttttgcgggtacatagcaggtacatatatttatggggttttttttaaagtctagatggattgaaaagtttaatattaatatgaaacattaaactacaaaaggatcaggaggaaagacagaaggtggtgatccctgaaatctagaagttttagggtagagacgtcaatctgtgtagaatgcaaagcttctaagtcattcctctgcttaaagcctgtcagtagctccccatggctctcaggacccaggctgagctcagatacctcctcctccaggaagtcctccctgacttcaaccttctggttaggttagaagcaaaccataagtggagaccttaggggcccacttacgttgggcaaggtactatatgatttcattataatgtatatggccctgtgacccacctcagagtcagggatggaggagcctggtgcagatactggcaaatcctttgatgatgagtgagtatagggatgcaagggtcggtgggggtgttgggtcctccctgggctccccagcagggaaggacggacgggagcccagccctggctgccccctcctgcccatggcccagcctccctctcaggcaccagccagtcccaggactctctgaaacctttcctgggctccttagtccagctccaagctgcccctctggccctgtgctacacctggtgctccctgctctcgcttccagccatcttctctagagtatggccagcccttcttctgcccggaagctttccttggctcccatggtctgagcataaacccaggttcctccgcctggcttccaaagcctccatggtcccttctgcacctgcttctcgagctgttgccccagacctgagatcagccccaccctgccttccacggggtgtgctccttccaccttgctgcctcggcctctttccctggcatggccgctcccgccctgcccaggtgatcagcctgtgaatcccctccctaacccccacacagagcacacctcccaggctggcttccggcttgactatgttcctccatgcctctctgagtagcaggatcaatgtgagaaaggtctgccctgtctgcagcctccccagaagcacagtacttttcgtggcgcgtacacgggctggtagatacagttgtccctctgtatccgtgggagattgcttctgggacccccaaggattctcaagtcccatatataaaatggcttagtacagttaacaacagagacgtgttctgagaaatgcatcgttaggcaattttgtcctttgcaaacatcacaggtatacttagcacaaacccagatggtctagcctactacacacctgggctatatgggatagcctatcgctcctagactacacatccatacagcatgttactgtgctgaatactgaaagcagctgtaacacaatggtaaatatttgtgtatctaaacatagaaaagatccagtacagctgggcgcggtggcttacgcctgtaatcccagcactttgggaggctaaggtgggtggatcacctgaggtcaggagttcaagaccagcctggtcaacatggtgaaacccccatctctactaaaaatacaaaaattagtgggacatggtggcatgcacctgtaattacagctactggggaggctgaggcagggagaattgcttgaacccaggagtcagaggttgcagtgagctgagatcgccccattgtactccagcctgggcgacagagcaagactccatcccccaaaatacaacaaaagaagtccaatacaaaataccacatcataatcttatgacacacactccgtcccgtctttaccttaaagatgtaatctcctgacacagaacttccgctctgtccctctagttccacagttcagtggtgcaatctcggctcactgcaagctccgccttccgggttcacgccattctcctgcctcagcctcctgagtagctgggactacaggcgcccgccactgcgcccggctattttttttttctttttgtatttttagtaaaaacggggtttcaccgtgttagccaggatggtctcgatctcctgacctcgtgatccacccgcctccgcctcccaaagtgctgggattacaggcgtgaccgcgccgtgacctcctgtggattttcatgggactctgagaggcgcctcaaatccattttggaataaggcaggttattagcatggggtctaaccgtgggctgtctcggtgtcctgggctggctcttggggcgggggtcctgatgtccgggacctcggtcctacctgggaggcacagatatggcggggaacgggaagcccgggggagcatttagaagctcgtgtgcacagggaaaccctgtctctacaaaaaattaaattagcggggcccagtggtgcgtgcctatggtcccagctactcgggaggctgaggtggggggactgcttgagcccaggaggtggaggctgcagtgagtcatgatcaccccactgcactccagcctggacaacagagcaagaccttgtctcaaaaaagaccccaggccaggcgcggtggctcacccctataacccctgcactttgggaggctgaggtgggcggatcacctgaggtcaggagttcgagaccagcctggccaacatggtgaaacacccgtctcttctaaaaatacaaaaattagccgggcatggtggcgtgcacttgtaatcccagctacacgggaggctgagacagaactgcttgaacctgggaggcggaggttgcaatgagctgaggtcgcaccactgcactccagcctgggggacaacagggaaactccgtctcaaacaaaaccaaaccccaaaagttctcgtctaagtccttctcccaggacaagggcacttatctcttggcggtgcgtcacaggtagggatattccgcgatccctcaccttgaccccgctacgaggacagccacctctttcaggtaaagagaccgcaatgggaaatcattctgataaaaattcccctgtggagaatgcaggcatcgatcccgttacctctcacatactaaacgaacgctcctccacttaagctgattccctagcccggcctaacctttgcagccggcgcatattgtggctcacgtcaccaccggtgtcccccgccgcccccgccccgcccggccagctcgccaccctattggatccctcacggctccggctccacggccatgatgggcttggctcaatttagttttaaaaagcattggccactcggattggtggtccgaagcgtccgtcaagcggaggacctgctgttgctacggcgtagggggtcccagccaggtttctccccgtttctgatttgtttctcaggctccggggtcctagaggttccggatccgtcaagtccatgggaaaagaatgcgcccctcgcgcttgactgacgaggcttgcgggccaatcggaatgtagtcaaaggagccgctaggcgatccaataggtagtagggggcgggagagaggggccaatgagcctggagctgggggcgggggcagggccgcgattggctgagaggcggccagagggcgggcgggggggaactcaaggcctgcttgatacgtccgccattttgggcgcttcgctgatggtgtcggtgagcgcgtttcccgcctgagcgcaactagcggcgggtcgtgggcacctccaggtaatgggggtaggggaggcgccggagcaggccgcggcgcggggtgtgcgaggcgcgcgggcaggcgcggggcccctccacctgggcctcagcggctcacggatggaacgtcccggcccctctcccctccccccccggaattcgtcgctccgcgggcccgggaggcgcggcgccgagtccttcccggccgctccccgtccgctcctgttaaccgggggccccgccaggacgggcgccgggagcgggacacggtcggggcggcgactttgtgcctcgttgacgttcgcagcctggcgcggcgggcgggcgaagcgcgcccctgacccggctctggctccaaccttcccgcccgccggccgcggcccgcagtgtgcccccccgaccgggcccgcgcccggtatccgctcccgttgggcctcccgggggcctcggggagcgcgtccagttgaggcagcaactcgccgtcaagagtgcgcgaagaccatggttggactctgctcttcgggagacaagttttgtgggtctgggttaattcgccgcagagtcatcgggatccacaccagccagttccgaggctcccagtacccttcccagtggctttttaactcctgtgaggtggcttgtatgtaaactgtctcgaatgcctccctggtgtatttgagccgggggtggggggggtgggtggtccttcttgtggcttgaagtccctccctcttaaagaagcccattcactgtttacttggaggtgtttcctgttgaggtcctgctggctgtgatcacaatttagactttttaattataggtgaacgggatgggtctttggatgtacctccgtgccctgacgtttcaaccgcgtgacttaatgtcattttcctggtacttcacgttttctctgtggggctttgggtctgttttgcttttatgggagggggtgcttgacaggcgttccctttcatcctcgcagcacttgttgacggggtggtgtcctttattcgtgggacgtttactttgattttgtcctcaaggtcatgttgcagataggcttcaagggggacagggactccaggtttccaaccaccgaactgtgcctcaagtagcaagtgtatgagacccggttatggtggtggttgggttttcctcactgtggagtggagtcagtgaccactttttagctctgtgaccttgggcaagttacccagcttctctttttttttctctgtagtatgggaataataataagtgtcccagccataagtttgtcaggataattgccctaatacatgtaaaacagctagagctgtgcctggcacatacagtcacctcagtggctgattagtggttaggctagttaatggctattattgtttaatttaaatttgatttttaaatgtttaggtactattgggaagtcagatgagcatttgagtcccgactcttggtgactgcctttagaaagctctgtgtaagactcagttgggctgaaaaagtaaaactataagttattttaattttttcaggacagggtttttgaccattccttaaattaggaacatttaccggagtaattaatgagtagtagcgcctcataatgtttaaagagatggttaaatacagaaaagcccatcacaagcttaagtcgggctttgttcctcatgtgcttttggatactagtttctgggtgactgccacccgaatcagtaactagggtttcttagtgtaagtcctccttgttactgaaaactgtaagggtgccgtggattgcagtattcttcagcaaagatagtttgggaaatagcttttgtcctggagggatactttggaaggtattctccacttcagcatgtctggtcagggagtctagaacattgaacaaaatgcctgcactcagtcagaaataaactcacaatcctttaccgcttgcccgatactctcctccatggtgctcgaaaccttgcgtgcaccttcccctggtattgttgtgtttacttgggacttggtttgctgtattggagatgtgtgttttgatggactcagtcttaagtagagatgagtatcttgctggtggaacttaaggacaggaagaagattgttttcggtttagaactctagcctttgtgtaaagtatagcaaagcaaagtcaacaagcaaaaagttgttagtttcaatgaactaattgagaatttgagaatcagaccatagctgagcagaaaatgaatagaagtaacattgacaggatgaggttgcctagctttttaagataaagctttggccgggcgcagtggctcacgcctgtaatcccagcactttgggaggccgaggctggcggatcacttaaggtcaggagttcgagaccaggccaacatgtgaaaccttgtctctattaaaaatacaaaaattagtcggtcatggtggcgtgtgactgtaatcccagttatttgggaggctgaggcaggagaatcgcttaaacctgggaggcggaggttgcagtgagccaagtccagcctaggagacagagcgagactcagtctcagaaaaaaaaaaaaaaaaaaaaaagatagggctttgcacctatttggtagattatgtgcttgttacaaataaacatctctttaaaacaagtgtcacgatcggtattttatttctatgacaacttccattgtctagttctatattttcagtatttgagaggcagcctctgtgtgtgtttgtgtgtgtgtgtgttttggtctaaaattttacagtattttactaaataagagtaaatgatagtgaaaataaagctcttctatctgctcaactaaaactcagcattgacttggtccttagaagttatggtctgcaccccagtattggctgctactttttctaatgtactgaaaaaaagatctggcctcttggctttaaacagctttcatatttctttcctttcttaacttcaaatgattgtcttttgatttactctagttcaagagttctcagttgggggtggttcccccctcaccccccaggaaacatttggcagtgtctggacatatttttgcttgttacacctctgggagtgggcagtgtgcttctggagggtagaggccaaggatactgctaaacatcctacagtgtccagcatagcctcctccctgcccgccagcaaaagtatccagtcccaaatagcaacactgctgaggttgagaaatcctgcacttagatagatgtgagactggcctacattagaataagcctgcattagaataattagaaattttttaagaccatggatgttggactccacctctggaaatggtgggattgagaatcttattaattttttttgagatgagtctagctctgtcgcccaggctggagtgtggtggtgccatctcggctcactgcaacctctgcctcctgggttcaagcagttctctgcctcagcctccctagtggcggggattacaggcacccgccaccatgcccggctgttttttgtatttttagtagagatggagtttcacatcttggccagggtggtcttgaactcctgacctcgtgatctacccgcctcggcctcccaaagtgctgggattacaggtgtgagctaccatgcccggccacgagaatctattttttagaagcttctcagacaatactgaaatgcagctgaattttggaaccactgttttacaccacaggtttagggactgtttgtgagttaagggttcctttcggtgatctgtgaacttggtctttgcagtacctagatcctgccttggagattatttagtagtggggattatttagatggtatacttaaccatttttcagatgcctgaagactgaactttagaagcatttgttaattgattttataaaatatcttaggacttttttttcttaacctcatgaaaatacattaccatactgtgctgaaactaagcaaaattcttagatatttagagtttgcttctgtgctgaataatcttacactactgtaatttttgagttagtatcttttgccctccttttgtcagtcagcggtcaggtctggttttagatgccagcttcaacttttttttttttttttcggagacagtctcactatgtcacccaggctggagtgcagtggcatgatcttggctcactgcaacctccgcctcctgggttcaagtgattctcctgccttagcctcctgagtagctaggattacaggtgcgtgccaccacacctggctcatttttgtatttttagtagagatggggtttcaccatgtgggccaggctggtcccgatctcctgacctcaagtgatccgcccgcctcggcctcccaaagtgctgggattacaggcgtgagccaccatgcctgttttttgtttttgtttttgtttttgttttaataaagacctattcccagagaattagccctggatcagtttaccagttctgcccattgagggcacagataggcatacagtatgctcagcctttaacacagtgatcctgcccactggtaagttggactcttctgtgccctagactctgatcccagcagagaagtgttcttttctcctggggagatgagatgcagtggtagagagaagggtagatcttttttgctcatattaaaatttagattatctagtttatggaatggaagaatattaggaaaactataaatttttagcagctaaatgttaatatctgaagttacaaaaggtcatggaggcattttcttattcttcatcctgaaattcggcctgtgcctatgttgagaactaccagtgaccaccatctacttctaatatccatttatttcatcagcaaatacattaattgagtccttactctgctaggaactgtattagggattcactgatgaacaggcccttaaggacctgcagtctagaggaagaggcaaacaagagacgacaaagctgttaagaattgtacatggtgtcaatggggcctgggaggaaagagcttctgtttgctggtcagttggttgatttgtttaaactttgggtggttgagattgccagaagttttgcaaaagaataagatagttacactttgttactcatttataagaaatgattacttcgacttgcctccttagtttgaggagtcttaaaaagcagtgccattcttcccatactgaagccgttttgtaatgacagatagctgtttatagctccctacacaacagttatcctttgaccaaacctcagacactgactctctggttccagacccgtccgaagcttgctgtaggtttttgcaaaatgtttccggcattcttgaaatagatgctacttcaagtgggagggggtgtttctcctgctgcattatggatctaggttgactggagattttgttttggccttttgactttggcttagatttatttgtcatggaagccccctttcctacttctcaccccctttagttttatgaggagggagatagttgctagttagatcaatactcagtttatttcaggtattgaaagattacagactgacatttggataccaggtaggttggctacgtggtaaagaagcaagtaaaagggcatttgacagtatgtggaaaggtatcttatctctatgcctagctaggacattttcttttttttttttttttttttgttgagacggagtctcgctctgtcacccaggctggagtgcagtggcgtggtctcggctcactgccagctctgcctcccgggttcacgccattctcctgcctcagcctccccagtagctgggactacaggggccggccaccatgcccggctaattttttgtatttatttatttattttgagacggagtctcacactgtcgcccgggctggagtgcagtggcgctatctcggctcactgcaagctccgcctcccaggttcacaccattctcctgcctcagcctcccgagtagctgggactacaggtgcctgccaccacgcccggctaattttttttgtatttttatagagatggggtttctccgtgttagccaggatggtctccatctcctgaccttgtgatccgcccgccttggcctcccaaagtgctgggattacaggcgtgagccaccgcgcctggccattttttgtatttttagtagagacggggtttcaccgtgttagccaggatggtctcgatctcttagtgagccgcccgccttggcctcccaaagtgctgggattacaggcgtgagccgctgcacccggccctagctaggacattgtcatgtcacagactgggcaaagagctggctttaccctgagtagaggctatttactaattgtcacttacggctggctagagttgacctgttttagatgcattagtgaagactatacagttgactgaacttatgcaattaaagttcgataggttctgaacatctttttacagatataaggaggctctgattttgtacttcacagtaactctggggaaaaccacgggattattagttccagaatttcttacagtggaaatacatagtgacttgaagtgatttgaattccccagagattgactaccgtgaaatctgatggcccaagaaaagatgaatgaaagattgtttttaggaacattagagagcaggactaaaacggctgcagactgatgttgagtcagacagacttggagaaagctgtgtgggactgttagttggagccttgggtttcctatacctacatgtaaatctgaacaaaaattctggtggcagagacacactttgagaaaaaagagcttgcctgagaacacatgtcacactgagaccctaatcagggcagttcacactgcctgctccatggttggctggtcagattggttgggctttggtcctcagatgggcgtagcgggaggaacactgactagtcttgacaattgactgaggcttccattcgtgagaatcatggttttgggctgcaacaacacttagacgtcatttattttctatttatttatttttttgagatggactctcagtctgtcgcccaggctggagtgtagtggcgcgatctcggctcactgcaacctccgccttacaggttgaagcgattctcctgcctcagcctcccgagtagctgggactacaggcgtgtgccatcacacccagctaattttttatttttagtagagatggagtttcaccatgttggccaggctggtctcaaactcctgacctctagtgatccgcccgtcttggcctcccaaagtgttgaaattacaggcatgagccaccacgcccagcgcatttattcttacagaaaaatggaggccatgcagaagaatggaaccagaaggagcagagaaatctcagccccggtgattccataggattgtgatgttccagaccacagttttaagtgctatttgtttcaagagtgacatcacagctggattttacttagaattcagaataagtggttaacgtctggaattttatttttggtagtagtatgtgtcagttttttgtcactgtatagtagttgaggagttcttttttgttgacatagagatacacagggtttgtattgcctttggacaatggacaggtctcatctgtctcttttgtctgcaagtgagaccctgccccttctgagtaaacaacactctgtgaatgactgtcccttttcactgtggacttcttgttattacacccttagatggactcagcagctatgagatcctcccatcataggtatggtattttgtaacaaaagtacagaaacacctccaaggtgcagtgaatgatctcaaggagagaaatggagtattataggatcatagagaggcctcgaggtctaaccagctgctctgcggaagtcagggtgatggtggtttcagtgttggggaggttacagagttagtgttgatatgcaaattttcttcctccaaatttggagtatgttatatatgttttaatgtatataactgtgaatatgaatataacattagaacatatataacataatttctgctggtggagtagagatcataaatttgaggtttgcagtttgctttctaaaacatcttttaagtttattcttttctggcacacaggacgttgtaggggaaatttgctgtggagtctcacatnttatatagaatcattttttcaacatagtgtggataatcacatacgccttgaaagatcaatatatgttaacagatgattggatctttttgattttgcaatttaatttctttacaaattttgcattataaccagacagctctattgagggtttgcagattttttctgtaaaggaccagttagtaaatattttaggcattggaggctaaatggtctctgcaaggactcatctctgcttttgtagtgtgaaagcagccatagccaatctgtaaacaaatgaaggtggctgtcttccaataggactttacttataaaagcagacagagagttggatttggcctgtgggttgtagtttgtcaatgcctgctctaatctgttttgtctttgtttatctttttgagatagagtcccaggctagagtgcagtggtgtaatctggagtgcagtggtgtaatcccaggctagagtgcagtggtttttgtttatttttttgagatagagtcccaggctggagtgcagtatagctcactgcagccttgactgacctccctggctgaaacgattctctcacctcagcctcccgagtagctgggactgtaggcacatgctactacacccaggtaattttttttttttttttcttgtagagacaagatcttccgatgttgcccaggctggtcttgaactcctgggctcaagcagtcctcccaccttgttttcccaaagtgctgagataacaggtgtgaactaccatgcctggcctctaatctgtttttttattttaacttgtaattggactatgaattcaaagagtatatatcagcatgtgcccagatattaaacattagaactgacacttgtgtacccactaaccagcttaggaaatagaaggttgccatacctttggctccctgtgtcctcgtctcaccacttccctctttctgacctccccaaggcaaataccttgtatgtatcatttttctgctttactttatggtgttgcaaagtataaatgtatccttatataatgtgacttcatttttgcattcctttagacaatgtaaatggagtcactttgttctttttttgcccccactcaacattgtttctgtgatccttttattcagatgtttgagtacttaccatgtcttaaacactgttctactgctgggcatgttaacagtaagcaaagcagatgaaaagtccttgttttcatggagcttacattttggtaggggaaagacagttaacagataaatgaaagatacagtagccatatggtaatacaaacagggagaaaagtaaaccaggagaggtggggtgtgggggagtgcttgtctgcagattgaaatacagcagtcaacagaaggagtggagggacccagccacaaggctgtgggtggcagtggggtaggggcagcattataggcggagggtcagcaggacaaggtgctaagaaggaggcatgtctgctgtgttggaggggcagcggaggccagtgtggctggagtgaggagcctgagggagagtgggaggagggtaggccagatggatgggggagatggggggagggcgtaggtcacactggccattgttaagattttgtctttttctctgagtgagatgggtaagtcatttggtgttttgagcagaggtgtcacatgatgtggtttctaaaggtcccactgtcctgtgctgctggagggaggttggacgctctggcagtgatccaggagagcagtaatggcagctgggactgaaggggagcaggggtgggagtgagaagaggttggctgctggatccttcttgaaaaggaagagcagacaggatttgctggcagattggagtgggtgtgagagaggagtaaaggatgataccagggatttttgtagctggtgggcgttgccatgtataaggaaagggaagacttgggaagaacagcgtgtggaagtaagatcaggagttgggttttgtgcatgttcagtttctgaagcttttggagagcagattggagatatgctggattggggtgttcactgctcaagggagagatctaggctgcagatagaaataggagtctttgggccgggcgcggtggctcactcctgtaatcccagcactttgggaggctgagacgggcggatcacaaggtcaggagatgagaccatcctggctaacatggtgaaaccccgtctctactaaaaaaaatacaaaaaaattagccggcttagtggtgggtgcctgtagttccagctactctggaagctgaggcaggagagtggcatgaacccgggaggtggagtttgcagtgagctgagatcgcgccctgcactccagcctgggtgacagagcgagattctgtctcaaaaaaaaaaaaaaaaaagaaaaagaaataggagtcttcaatatttaggtggcatttaacagtcccgaggttgagtgaggcactgaaggaatgaggctctacggcagcctagaaggtggaaggagcagctttgaggccttaggaaagtgttgtcacggaggatggagcggggacctctgccagtgctgctgccgtgaggtcacctgagataaggaccaagactcgtctcatggctctggcagcgtggaattcatcgacgatcttgagagctgttcccacatggtggtgcaggaaaagcctggaagggagcattcacaaggattgagagaagagaaaggcaagtagagctccgtcatgggatttgccacagtgatgaagggatatttgggatcctgaggtgttgaggtgggagaaaccacaccatttttgcagtgttggtgaagtaattctccagaggatgaatgacatgatgaatcagaagaggtgacccttgctggagccacattcttgggaaggcagcaggaagtgggtgggtgcccatgtggagagttggcatccatgggctcctccctggtaggaggagggagagcagactaggggagatgggatagtgggagcatgtggacgttggcttttttttttcttggtgaaatggaagagttctcagcagtcagtgagaatgagggggtgtcagggctggcggggtgtgaggagagaggaggaagtatgacatactctgtgggaaagtaagaatgtgtgtgaatggaatggcctacctgagggtagcagtcctgagttgcagtgaagacagcacgatttgttatttttcctggaaggagagtaggcattgcttcatttaactggggttgtggtttccctaatcagaaatagcaaagcaagagagaggccaggaagtgatgatgttggtgggacgtggtggtaaagccgggaagggaaggcgtgcagacggagaggtttgcccacattggtgcgtgtggttgtggtttatccttcttcacttctctgttacattgcagactgaatatgtctcattttcttctttgtcctgccattggagaatataagtgtctctagtaagaaggaacgctgccttaaacaagtgcagatgcatttctccagggtaccacccatgtagagaattgcagggtagtgcgacatgtacatcttcaactttactagatggtgcaaattgttttccaaaatgattgtacctctttacctcactaccagcaccgtcctacatccttgctagcccttggtattgtcagactttaatatttgcaggtttggtggatgtaaacttatatctcggggtttttttttttttaatgacaacattattgagaagtaattcacagactattcaattgatcaatttaaagtgtacaactgatggattttaatatattcacagaactgtgcagttatcaccacaatctaactttgtaacatttttgtcaccccctcaacgacaacaaaaccaccttgtacccattggactattctggacattgcttattaatagaatcatacaataggtggtcttttgggaccagcttctttcaacttagcatgttttcaagtttcatccatgttttagcatgtatcagtatcagtccttcattctttttagttgctgaatagtgttcaattgtatggatataccacattttatttatccattcatcagttgatggacatttgtttcctttgaaatatatagttgattttcatccttggcatagtttccgggcatacagctcctaaaatctttggactttccaaaatgataagtgtctttttgtatgcgaatgagttgactgatggctagctgacctaggtagcttcaggttaggggctggtcactggaaagaccatgattagagggttgggactttcagctccacctccagccttcagtgagaggagatttgctgaacattgaattgatcaactgccaatgatataatcagttgtgcccaagtaatgtcactgccataaaaatctggaaagactgggttctagaaacttctagaacacatggaggttcctggagggtggtgtgcccatagagggcatggaagctctgagcccctcccctcttaccttgccatgcgtatctctccatctgtatcctttgtaatattgtttatgataaactggtaaacttgtttccctaagttctgtaagccactctagcaaattaatcaaacccaagaagtgggttatgggaaccccagtttatagctgttgcgggggaagcacaggtaaaacaacctggagcttgtgattggcgtcagaagtcgagggcagtcttgtgggactgagtcctcaccctgtgggatctgactctatctccaggtagatggtgttggaattgaattggaggacacccacctggtgtctgctgcagaactgattgcatgatgtgtggtcacataagtatcctgtgttgattgttaagggaaagaataggaaaaacactctgctttgttatttttgtctctttattactggatttctactttttggctgttgtgagtaatacttctgtgaatatttgcatacaagtctttgggtagacatggttttatttctcttggtgtatacgtaggagtggaattgttggataatgtggtaactttaacattttgaagatttgccttttccttatggctaatgctgatgagtgtctttttacatagcttgttggctatttgcatgttaaaaagcaattacctttttttttttttttttgagacaaggtcttgctctgtcacctaggttgaagtgcactgtggcatgatcatagcttactacagcttcaaactcctgggctcaaggaatcctctcgcttcagcctcccgagtagctgggactacaagcacacaccaccatgcctggctaatttttacaatttttgtagagacaggggtcttgctttgttgcctaggctggtctcgaacttctggcttcaagcagtccacccaccttggcctctcaaagtgttgggattacaggcatgtgccactgcgtccagcctgattatcttttaaatatcatattggctatttgtatatcttatttagaggaaagctcacttaaatcttttgtccttgcttttttttcaaaaaagaaatgctgtatttttcctgtttttaacttacctaatgccttatgatttatgtgtccatgttcatggtgagattggcctgtaattttcctttttttatatcaaccttgatgagttttattatcaagattattctagtccaataaaacaaattgtagtatttcctcatttgtctcttgagagtttatgtaaaagggaattatctgttccttgaaggtttggtaagccttgctggtaagaccattggggcctagtgttttctgtctcagatttttaaattacttatttggatgttttaatatttataggattattaaaatctttgttttttcctgagtcacatttggtagtttatgttaaaaagtttgtttattcttgtctgtattttcaaatatattggcataaaattctgacttactatcttttgcatctctatcatatttgtaatcactaatatttaacttccttttttttattttttttatttttatttttttcattgatcattcttgggtgtttctcgcagagggggatttggcagggtcacaggacaacagtggagggaaggtcaacatacaaacaagtgaacaaaggtctctggttttcctaggcagaggaccctgcggccctctgcagtgtttgtgtccctgggtacttgagattagggagtggtgatgactcttaaggagcatgctgccttcaagtatctgtttaacaaagcacatcttgcaccgcccttaatccatttaaccctgagtggacacagcacatgtttcagagagcacagggttgggggtaaggtcatagatcaacagcatcccaaggcagaagaatttttcttagtacagaacaaaatgaagtctcccatgtctacttctttctacacagagacagcaacaatctgatttctctgtcttttccccacctttcccccttttctattccacaaaaccgccatcgtcatcatggcccattctcaatgagctgttgggtacacctcccagacggggtggtggctgggcagaggggcttctcacttcccagaaggggcggccgagcagaggtgcccgccacctcccggacggggcagcggccgggcgggggctggccccccacctccctcccggacggggcggctggccgggcgggggctgcccccataagcgctaacttaagggttgaaccatctgaagaatgcgacgcctcggtgcctcgttaagacgatgcctcgcgttcttcaattgcgttttgtaggctgtcagggatactgtcccacgaatggccacctgtaagctccagatgaccatttttgttattctccacaacgagttagttcttcttttcggatccggcacttctgggggggaaatccagcgatggctggattatgtcgtcaattaaaaatgcggcgagtagattagcaaatatccacgctttcgcgagttcaggttcctttgcacgcaaagcatccaggtgcagcaaacttttgagccgcttaaaagccagttcaatttgccatcgcagacggtaacaatcagccacttgctctgctgaatattcatcttccggtaatgatgttagcaatagcacatggcccgctgcttccagcgtttccgcctgaactactcgtccttttcgacgattctcgctgagcagtcgggttttactgattaatgctttttcgggaggaagtgatacggcaatgagacgtgccggaaagggagctccggcttttttattacctgaattgcctatcattacagtggtttcaccgttcttaccgcaatccagcccgcgcagaaaacccatcatgtcaaagcgcattccttctgcagttaaccagcgcaatcctcgccagtgaacccggacgatataatcagcttctccaaaagcaagtgagcggatacattcgggacgcgaaccgaatccccggtcagcaatgcgtatctcgtctgccgtttgcgcaaatcggtccagccgttcagcgtctctgctgtcggttagctcaaaatcagtgaactgacaggtatgaggatcatatcccatatgtagtcgccattcagcgctgccgcccccgggcgcactgattgctgttccatcgacaagacgcaatctctttccgcttgtacaacccgtaactgcggcgcgtacagcaagtgtttgtgcggcaagtatgccaaaccagtcggcggcattccgcagccgcttcaggagagccacgtcagataatgttgcaacgtcatggagctgagcccatgcagtgacttcacgtaatgacatccccccggggccgtaagccagccccagacgtagcagagttgcagcatcacgaatttcgcggcggcgggttagagccccggcattacgtgccgaagtatccagttcttcgggcttaccaatatgggccagaattgctgaccagttatcgtgagagtaattcatcggcacgttaaatcatatcaggcgtaataccacaacccttaagttagcgcttatggggctgccccccacctccctcccggacggggcggctggccgggtgggggctgccccccacctccctcccggacggggcggctggccgggcggtggctgccccccacctccctcccggacggggtggctgccgggcggagacgctcctcacttctcagacggggcggctgccgggcggaggggctcctcacttctcagacggggtggctgccgggaggaggggctcctcacttctcagacggggtggccgggcagagacgctcctcacctcccagatgggatcgcggacgggcagaggcgctctccacatctcagacgatgggcggccgggcagagacgctcctcacttcctagacgggatggcggccgggaagaggcgctcctcacttcccagactgggcagccgggcagaggggctcttctcatcccagacgatgggcggccaggcagagacgctcctcacttcccagacggggtggcggccgggcagaggctgcaatctcggcactttgggaggccaaggcaggcggctgggaggtggaggttgtagctagccgagatcacgccactgcactccagcctgggcaacattgagcactgagagaacgagattccgtatgcaattccggcacctcgggaggccgaggctggcggatcactcgcggttaggagctggagaccagcccggccaacacagcgaaaccccgtctccaccaaaaaaatacgaaaaccagtcaggcgtggcggcgcacgcctgcaatcgcaggcactgggcaggctgaggcaggagaatcaggcagggaggttgcagtaagccgagatggcagcagtacagtccagcttcggctgggcatcagagggagaccgtggggagaggggggagggggagggggagggggagggctatttaacttcttaaacagtatgtttaggtcattaattttcaacctttttatatacttatatgtacatacatatctaaataaagtagtaatttccttttaagcaccactttagctatatgctataagttttgctatgtataatttttatctttaattctgaatatattcagattttcattatgatttcaaatcttggcatatatatctttttaaaatctttgttattgatgacaaacttaaattgtgttaatagggctggtgtgatggctcacacctgtattcccagcactttggaaaacctaggcaggaggatgcttgagcccaggagtttgagaccagcctggacaacatagtgagaccccagctctacatatatatatttttttatttagctgggcgtggtggtttgtgcctgtagtcacagctactcaggtggctgaggtggcaggattgcttgagcccaggagttcgaggctgcagtagtaagctatgattgcaccactgtactccagcctagatgacagagtaagaccctgtttctttaaaaaaaaaaaaaagtgttaataaaatgtggtctaatgcgattttgattctttgaaatgtgttgaggctagttttagtttgtgcagattttcatcactattctatgtgtgtttaaaagaatgtgtatttccagattataaggtgaggcttttccatctctgttcaaactagtatccttaatttttttctgcttgttctgttagttggtgggggatgggggtgggtgttagaatacaacaccggatgtccctgacttgccatagtctgacttaggatttttccactttatgatagacttattgggacataaccccattgtaagttgaggagcatctggacttcatgatggctcaatttatgctttttcagctctgtgatgagtttatcagggtattaaattcattttcatccaggtgcagtgacttatgcctgttatcccgacactttgggagtctgaggtgggaggatcaattgcttgagtctaggagtttgagaccagcctgtgcaacatagggagaccccatctctacacaaaatttaaaaaattaggttggtatggcagcgtgtgtctggagtcccagctactcaggagactgaggtgggaagatctgcttgagcccaagaggtcgaggctgcagtaagctgtgattgcgccactgcactccagcctgagagacagagagagacattgtctcttaaaaaaaaaaaatatatatatatatatatatatatatatatataatttccaacttacagtcgattttttgggacataaccaaccccatggtaagttgaggaggttctgtaccttctatgatgggatttgtcagattctgtagcactcagtttttgcttttcatctgtaaagtttagatttttttgtgtgtgtagagacaggctcactgtgttgcccaggctggtcttttttttttcttcttgagacagttttgctcttttgcccaggctggagtgcagtggcgtgatcttggctcactgcaacctctgccttccggtttcaagcgattgtcctgcctcagcctcccaagtagctgggattacaggcacccgccaccatgcctggctaatttttgtacttttagtagagatggggttttaccatgttggccaggctggtctcgaactcctgatctcgtgatacacctgcctcagccttccaaagttctgggattacaggcgtgagctgccgcgcccggcccaggctggtcttttaactcctgggctcaagcaatcctcccactttggcctcccaaagtgttgagatttagaggtgtgagccccgttgcccaagcaagttaagaattttaaaccttcctgtgacttgcacaatttgtcattctgtaaatcttcatttctgtgaatattttcccactaaagtatatatataggccgaaaacttaagtatcttttgtcaaggtgttatgtaactatgacaagtgacttttggttactatttgccttatatatctttttctgcccttttactttcaagctcttttgtggccttaacgttttaggcgtgccttttgaaagccacacatagctaaattatagtttataatttgactctcaactgatgagttagtgcacttggtaagttttttttttttttttttttttttttttttttttgagaagatggagtctcgctttgtcgcccaggctgtagtgcagtggtgtcacctcagcttactgcaacctccgcctcccgggttcaagtgattctcctgcctcagcctcctgagtagctgggactacaggcatgcgccaccatgcccagttaagttttatgtcttcagtagagagggggtttcaccatgttggccaggatggtctccatctcctgacatcgtgatccacctgcctcagcctcccagagtgctgggattacaggcatgagccaccatgcccggccagtctgaacgtaattttatacaatattttcatatatgaaagaagtgtgtatacattgaaccatcagaaagcaaaggtgtcaccatctcagccatccatgttgacagtctgcggttgctagacatcactattgttcctgacatgaatttataggctatcaataagcaatcatattcttacgattattcacatgtaagtacttaacagtaagggatatggcgtaccattaatacaattaaaaaataatgcgtggagggtaactaagcagcatagttgtatcactggaatacctgtaaccgctattaaacagcagcagatgcagggggctgggagggtctttttccccttggagacgcggaataaactgtgttgtgtgcctgcattttgactgtggtctgtcacatgaggtcaaggtggaattttttacttgtggtattaaaaatgtttggattttggagcatttctgattttggattgtttgatgagggacgctcaacctatacttttatattgtcattcttaaaaggttgttttgcctaatacccagttctggctcgatgattgttttcccttagcactttgacagcactttcatcttctttttccattgctggtattgagagtgataagaagttagatgtcagtcgtttctctgcaggtcatctctagcttctaacctctttctttcattttttaaagtctttttttctccttgttcttcaatttcactaagaattatttatgtagagttcttatttcttatcctttctctgcctgagggttggtttctttctttttttttgagacaggtccttgctctgtcacccaggctggagtgcagtggtgctatcctggctcactgtagcctcggacacctggactcatgtgatcctcccacctcagcctcccgagtagctggaactacaggtgcaagccaccacacctggctaatttttgtatttttttatgaacagggttttgctatgttgaccaggctgttctcttgggctcaagtgattatcctgccttgccctcccaaagtgctgggattacaggtgtgaattatcgcgcctggcctggtatatttcttcaattaaaaaaaaaaattctcagccatttttgctttgatatttctcacctgctttttcagttgtctctttctagtactctgtttagatcttatatttagtatattttctataatgtgttgtttcagctatacggaccatatattctgtaggtaataccagtggttgcatgcttttctgctctgatcttttgatgtttctttctgaaaacttatttcctcttgtgtttgctgtttttgattttgtggcaaccaatctttgtctgccatgctctaatttgatgagaatggccaaatgccctcagtacatttgtagtcaatgttcagcaaatatttattgagctcttctgtaccagacactgtctgggcacttggtatttaccaaagaacagaatggataatattctgcaccttggcggaacttagcatccagtgaaacaaacttctagggtagggatggaggtagctgtgagaattttcttgtttttatcagcctagctttgcatttaaagaggtgctttaatatcgtgtccaggatttttacatattctgggcttaaagtgctcctcatgttggccagtccagcaaatgtttgttttgttttatttttaggttgctggtattatctgctattttggattattcttttggtgtcttgatacgtccaaataaccaagtaccagatatgtgttttgaataagcgtcagctagtattcaaaatattttaaaaattacaataggggagtttcattttgctaagagttagcaaatatatgattttttccccctccttcaatatggagtgttcatgtgtcaatttcaggaatttcttagagattttcaactcttttacattaggtagctcattttttatatccagaaatgggaatgatttcaaggataattaccattttgaaatgggatcatttgcttgctagaaaatgttaacattgactccagccaagtacagaacattaaaaacaatctggaaaaaggggtgtggatcaaaatagattatgagccaaatctgtctcgaggaaggaagagagtagagtttagcatttataatacatggcctatcccaagagaggggagggactattttatacataaaaaaatattaaaagccttactttgaccaataaattaaaaagaggccatcagaaacaagagccgtggagggacataatgacacataggctggggctagtactggagttcattttgtgacactctggtggcaaatcctgtcagttctggtcctgtctctgcctctgccatggccttcattgaggagggttaggggatttggtggcagcaggagcacactgctgatcccagaagcatagggttaagaactaactgccttgaatacgatcttagtgattttcagtggagccaaggagtttgaaatgcataggcaatgtaacttcatcaaacttcaaagagccaagcttgataatctttcagggttgtgagaaaaggatgagaaaggattgtagaggacatgggttagagagagcgagctggtttagcagaattgttgtgaggattaaagataaatattggtgggcatgtttgtatctatctctagaagaaactagagtccattctctgtttaccatattgtcaggcctaactaacatttttcactttttggtatcagttactagtaaagtgcctcatggttagtgtaaaccttcagcagcctgccgtgcttactcacctccacttgcaggaggcaggtgtgtctttattttgcttgctgagtccctgctattaaattgtcacttgcgcttggttctttatatgtgttacttttaactctttattccttctagatgagtgtgaggtagtcatcttgagatgaagcagctgggaagcagggaggcagtctggccatagcggttaggaagagggtcattaaggtggtcagaagtgggatagaaccttggtttgaccactgactacctgtctgaccttgggcaaattatctcacctttctaagctccagtttcttcacatgtaaaatgagaatcatactaaaattatcccggccgggtgcagtggctcatgcctgtagtcccagcatttatcactttgggaggccgaggcaagcagatcacctgaggtcaggagttcaagaccagccttgccaacatggtgaaaccccatctctccaaaaaaaaaaaaaaaaaaccaaaaaaacctgaaaaacaaaaattagctgaacgtggtggcgggcgcctgtaatcccagctactcaggaggctgaggcaggaaaaccgcttgaacccgggaggcagaggttgcagtgagccaagatcatgccagtgcattccagcctgggcaacaaagtgagactgccaaaaaaaaaaaaaaaaaatttcctctctttcccatagaaaatgactttgggtaatttgaaattgtggagtgttttgtttttgcaagttttctagtgtagaagtcctaaacttacacagaataagtggttaaatgttaatgaatagtagcctattttatggactctggcttggttttgaagtcttgactgtagaggtaggatattgtaaacttttttattcaactgactttgtttttttggtttgggatagaaagtcttagttttttaaaaaaaattaatatgtgatatttattttgaaaaaaattatagagaaggctaaaatccattctgatcaccttttccaaatccttttccatcttctgttgttactggttttgtgtctcctttcttgattttttttctgtatatttgcatatatatgctgggtatgtgtgttttatataaatataatagcaccatactattgtgccgttcttttttcattcatctcttttcactgagtcccatgtagtactaataggtctacctctttctttttaatagctgcatactaagggtatactttatagccatttcccatatcaagggtctttagattttgttgttattatcacaaacaattcagctggcttttagttcaatgtaataaagttctttgttcttagaagcctttagaattatattgtttagtgcagaaataaaacactacaagctgagttattttgcttttttgtctttgcaagtaaagtacaaatgtttaagcaaagggaagaaaacttttcttagaaaagtattttgtttacctcctttcaaaatgagatacgacattgcttttaaattctataaatgaccaattatttagcaaatcttttaaaattgtgggaaaatacataacataaagtttgcattttcaccatttttaaaaaagttcccagcaaaattgagcaaaaaatatggaggagagttcccatatactcctgtccccacacttctgtgataacatccctcaggagaatggtgcatttgttagagttgatgaacctacaccaacacattatcatccaaagtccatactttagggtgtactcttggtgttacacattctataagttttttagactggagtgcagtggtgtgatctcggctcattgtaacctccgcctctcaggttcgagttattcccctgcctcagcctcctgagtagctggaattacaggcatttgccaccagactggctaacttttgtgtttttagtagagacagggtttcaccatgttggccaggctggtctcaaactcctgacttcaggtgatccgccttctttggtctcccaaagtgctgggattacaggcgtgagccactgtgcccagtcatattctaaaagttttgaaaaatgtataaggacatgtagccaccattgtagtatcatacagaatggtttcactgccctacagatcctctgtgcctcatctattcatccttacctccctgcaacctctggcgaccactaatccttttactgtctgcatagctttgtcttttccagaatgtcatacattgtttatgtagccttttcatattggcttctttcacgtaataatatgcattaagttttcttcatgtcttttcatggcttgatagctcattcctttttagtgctgaataatattccattgtctggatgtgcccaaatttattcattcacctactgaaagatagcttggttgcttcccaattttggcaattgtggataaagatgctgtaaatatccgtgtgcaggtttttgtgtggacgtaagttttttcactttacttcggcagataccaaggagtatgattactgtattgtacagaaagagtatgtttgctgtttggaagaaactgcccacagtggctgtaccattttatattcgcaccagcaatgaatgagagttcctcttgccccacattgttgacagtgtttggtgatgtgtcttgagtttggccattttaatagatgtgttgtgctatctcattgttgctttaatttgcagttccctaatgatgtatgatgttgaacatgttttcaaatgcttacttgctgtctgtaatgtttgctcaggtcttttgtccattttttaatcaggttgttcatttttttgagttttaagtgtctatatatatttttatatatatataatataagatacatattttgagacggagtttcgctcttgttgcccagggtggagtgtaatggcacagtcttggctcactgcaacctctgcctcctgagttcaagtgattttcctgcctcagcctccggagtagctgagattacaggtgcccgccaccacgcccagctaatttttgtgttttagtagagatggggtttcaccatgttggtcaggctggtcccaaactcctgacctcaggtggtccacccacctcggcctcccaatgtgctgagattacaggcatgagccacagcgcccagccttctttatatatttttggataatagttgattatcaaatgtgttgtcagattttgatcaggattgcattgaatctgtagatcaagttaggcagaactgatatcatgacaatattgaaccttcttatccatgaacatggaatatctcttcatttgtttagttcttctttggggtctgtcatcagagttttatagttttccttatatagatcttgtacatattttgttttatacctaagtatttcattttttggatatgttaatataaataattttttttttattttcaaattccacttgttccttgcaggtatataggaaagcagttgatgtttgtatattaaccttgtagcctgtaaccttggtataatggcttataagttctgggactttttttttttttttttttcaattccttcacattttctccatcatgttgtctgtcaacaaagacagttttattttatgctttccaatctgtatactttttatttccttttcttattgaattagctaggacttccagtatgatatgatggaaaaggatgatgagagggaacatctttgcccgcttcctgatcttagtgggaaagctttaatttctgaccatcaattatgatgatagttgtaggtttttgatatatgttgtttatcaagttgaggaagcttcttactgttcctagttttctgagtgttttttgaaatgaacaggtgttggattttattaaatgccttttctgcatctgttgatgtgatcaggtgagtcttcttgaacctactgatgtgatgggtcatgttaattaattgatttaaaaaattatttattttgagacaagagtctcactttgtcacataggctggagtgcagtgggatgatcttggctcactgcagccttggcctcctgggcttaagcaatcctcctgtcttagtctcccaagtagcagggactacaggtgtgtgccatcatgcccggcgacagatttttgattattaaagcagccttggctgggcacagtggctcacacctgtaatctcaacactttgggaggccaaggcagacagatcacttgaggccaggagtttgagaccagcctgagtgacacagtgaaaccactttcttaactaaaaatacaagaaaaaaaaaaaagctacacctaattttttgagactcaaaaagagtctcaaaaagaaaaaaattaaagcagccttaaatacgggataaatatttggttgtggtatataattttttatatataatgctttttatgtataattatttttatgtattgattcagttttcccatattttgttgaggatttttatatctgtgttcatgagagatactgatttgtacttgccttgtagtgtccttgtctgattttggtattatggttatgctgacctcatagaatgaattagaaagtattctgtctgcgactgccgggtgcagtggctcacacttgtaatcccagcactttgggaggccgaggcgggtggatcacaagttcaggagatcaagaccatcctggctaacacggtgaaaccccatctctcttaaaaatacaaaaaattagctgggtgtggtggcgggcgcctgtagtcccagctacttgggaggctgaggcaggagaatggcgtgaacccgggaggcggagcttgcagtgagctgagatcacgccctgcactccagcctgggcgacagagcaagactctgtcttaaaaaaaaaaaaaaaaaaaaaaaaattccgtctgctgctttctattttctggaagcaattttagagaattggtattattttttccttaaatattcagtagaattcaccagtgaacccatgtgggcctagtgctttctattttagaaggttattattcaaattttaaatttataggcccttaagattatctctttttgtgtacattttggcagattgtttctttcaaggaattgttccatttcatttaggttattaacattttgagcatagaatagttgataatatttccttattcttctaatgcccatggtatctgtagtaatgtcatttttcatttttggtattggaaatttgtgtcttctctcatttctctttctcctcagcctggctagagttgcgctgattttattgttgtttcctgaaaaccaccttttgtctttttctctcttgatttcctgttttcagtttcattgatttctgctctaattcttcttttcttatgcttactttggaattaatttgctctactttttctggtttcctaagatagaagatcagattattggttttggatcttcttttttagtgtattactcaatgctataaatttccttctagacactgtttttgctgtatcccacaagttttgataaattgtatttttcaaggccaggtgcaatggctcatacctgtaatcccagcactttgggaagctgaggcgggcggatcacttgaggccaggagtttgagatcagcctggccaacatggcaaaactctatctccactaaaaatacaaaaattagccggggcatggtggcacatgcctgtaatcccagctactcgggaggctgaggcatgagaattgcctgaacctgggaggcagaggttgcagtgaatgtagattgcaccactgcactccagcctgggcaacacagcaagactgcctcaaaaaaaaaaaaaattgtatttttttttatttagttaaaaatactttcaactttctcttgagatttcttttttgactcccatgttatttagaagtatattatttaatcttctggtatttggggatttttcagttatctttctgttattgatttctagtttaatttcattgtggtctgagagtacattgtatgatttctgttatgtgttttaaggctcatagtgtgggctctcttggtgaatgttctgtatgaacttgagaactgtaatctgctgttgttgaaataatgtatagatgtcaattatacccagttgattgatggtgctattgagttccatcatgtccttactgattttctacctgctggatttcaccatttctgatggaggggtgttgaagtttccaactataatagtagattcatctattctcccttgcagttctatcagtttttgcctcatgtattttgacactgttattaggcaaatacacattaaggattgttatgtcttcttggaatatttcttcctttatcattatgtaatacctctctttagccttgataacttttcttgttatgaagcctgctctatctgcaattaatacagctactcttgttaacttttgattagagttaacatgatatatctttttccatccctttcttttttttttaaacagggacttgctctatagcccaggctgcagtgcagtggcacagtcatagctcagtgtaacctccaagtgtgtgccaccacacccagctaattaaaaaaaatttcttttttgtagagatggtgtctcgctgtgtttcccagcctggtcttgagctcctgggctcaagcagtcctcctatctcggcctcccaaagagttgggattataggtgtgagcccagccccccattcctttacttttgatctacgtgtgtctttatatttaaagtggctttgttttcttatttttggtttttgtatttttattgggagctacaggggaacggcttcttccctgtcaacggaggtgctcacaattttctcagccactccaagcttgggccctagagcacctggggggtcctgatggtggctggacacatcaggcatgttctcatcatgtagaaggggcactgggtagttgtagggtgtgtcctgattgatcatgatggcctacttggtgtaggggctgagtaggggcagaatcacagaagctggtgatggttaaggacacattggctcaggcattcttgaggaatgcaacaagtctcgctgccatcttgatcttgaaggtggcaacagctaggttccttgtagacaacatatagttgggtcttattttttgatacattctgaaaattgctcttttaataggtgtatttagaccattgacctttaatgtgattattgatatagttgtattaatatctgtgatatttattgctgttttccaggttttgcctttttttttttttgaggcagagtctgcctctgttgcacaggctggaatgcaatggtgtgatctcggctcactacaagctctgcctcctgggttcatgccattctcctgcctcagactccagagcagctgggactacaggtgtctgccaccacgcccggctaatttttttgtatttttagtagagacggggtttcaccatgttagccaggatggtctcgatctcctgacctcatgatccgcccgcctcggcctcccaaatatttttttgtttgtgcttttgtcacatacactttttctgccttttttggttttaattgatcattttatatgatttccatttttatcttctttcttagcatatttgttaaactttttttagcttttaaagggttacactggagtttgcaacatatatttgcagttaatccatgtccactttcaaataacactacagaggtagtgcacatacaggtattatacgtcgttttattgtggctcactttctttcactttgcagatactgtgtgtgtgtgtgtgtgtgtgtgtgtgtgtgtgttttaatgaacaaattgaaggtttatggcaaccccgtatttgccagggtatcagcgccatttttccagttgcatgtgctcacttcattagcatttttttattggtaaaatacttataattaaagtctgtgcttttttttttttaagacataatggtattgcacacttaatagtgtaaaaataatgtttgcatatgggaaaccaatatattcgtgtgacttactttattgtgacatttgcttttttgcgatagtctggaactgaacctgtaatatctccaaggtatgcctttaccagtaataacaaatatttctgattccgccttcctgtctcattgttgccattcattttacttataagcacgcataaatacataaggaagcatacttaatcgagtacattgttattgttattattttgaacaaactacttttaattaagaataagaaaaatcaattttttttgaatcttcacttaattccctctccagtcctctaatctgtgtttcctacctggatcattttccttctttctgaaataattttggcaacataggtttcctggaaacaaatcccctcaattttgtttgtctctttcactttgaaggatactttttcagggtgcagaattctaggttggtgttatttttccccctctcagtgctataaatatttcattctactctttcctgcttgcatggtttctaagaagttagatgtaattcttgcctttgctaccctgtaggtaaggttccctcccaccttgatttcttttaagatttttttttgtttttgattttctgacatttgactatgttattgctcagtggtgtttttttttggtggggggtaagtggggaggtcattgcttggctttttattggcattgtttcctgaactttctggatctatggtttggtgcctgacaacaatttggaaaaatctccgtcgttattacttcaaatattgcttctttcctcttttttccagatattaccatcacatatgttataccttttgtagttgtcccatagttcttggatattttctgttttttttttcttttgtatttttttctctttccttttcagttacggaagtttctattgtcatatcctaatgctcagattctttcttcagccgtgtttagcctactgatagatccacagagggattcttcatttctgttacagtgtctttttctctagcatttctaattggttatttcttagaatttccatctctctgcttatgttatctttctgttcttgcttgttgtctgcctttttcactaaagcctttagcatattaatcgtgttttttacaaaattgctagtggccgggcatggcctgtaatcttagcactttgggaggctgaggcaggcaggttgcttgactcaggaatttgagaccaacctggtcaacttgatgaaaccccatctctacaaaaagtacaaaaattagctgggcgtggtggcacacacctgtagtcccagctactttttggggctgaggcaggaggatcacttgagcctaggaagttgaggctgcagtgagccttgtttgtgtcactgcactccagcctgggtgacaaagcgagatcctgtctccaaaaaaaaaattgctggtttggtaattctgccattgcagccatatttgactctggttctgatgcttgttcagtgtctttattaaaaatttttttttcagagtctcagtgtttaaaccagaaggttgttaagtgtcttcagctgtgtgtgtgtgtgtgtgtgtgtgtgtgtgtgtgtttgagacagagtcttgctctgttgcccaggctggagtgcagtggtgcaatcatcttctaggtgcaaggatcctcccacctcagcctcctgagtagctaggactacagtcagacaccactgtgcccagctatttttttaaaaatttattttttgtagagatgggtgttgctgtgttgcccaggctggtcctgaacttctgggctcaagcagtcctcctacttcagcctcctaaagtgtcgggattataggtgtgagccaccagtcccagcccattttaactgtttggagtgtaccgttcagtggcattaaatacatccacattgttgatcaaccatcatcaccaccatccatctcctgaatggttttcatcttcccatactgaaacacagtagccattaaatcatcttttggcttccctgggccacattggaagaagagttgccttgggccaaacataagttacagtaacactaacgatagctgatgagcttaaaaaaaaaaccacacaaaaaactcaacgttttaataaagtttatgaatttgtgttgagcctcattcagagctgtcctgggccacaggttggaccagcttgcattaaacactaactcctgctcccgcccagaccctggcaactgccgttctactgtctccatgaattcgactattctaagtaccttgtgtaaattgcatcatacagtatttgtccttttatcactggcttcaagcacagtgtcttcaaggtttactcatgttgtaggatgtgtccgaatttcctttctttttttatttttaaattttttagaggcagagtcttgctctgttgctggactacagtggcatgatcatagctcactgcaacctcatactcctgggctcaagggatcttcccacctcaacctccctagtagttggaaccataggtgtgcatcaccatgcctggctaagttttatttttattttttgaggtcttgctatgttgcccaggctggtcttgcctggcttcaagtgatcctcccaccttggcctcccagaatgctgggatttcaggcgtaagccactgcgcctgactagaatttcctttaaggctgagttatatttcattttatgtatatacaacattggttatccatttatccatcaatggacactacagtgcctctgccttttggccattgagagtgatgctgccatgaacatgggtgtataaatatctgttcaagtctctgctctcaggtctttagggtatataccaagaagtggaatggctagatcatatggcagttctcattctacttttttgaggagctgccatactgttttccatgactgtaccattttacatttccccagtggcacatgagggttccactttgcccacattagctagcacctctttttgagtgtttatagacatgagctgtacagtggttttcaaagcattgttggttgcttaaatctttctggcagcaaaatccagggaggttttctttatagaatttacaaggtctgtgttactatattttcctggttttcttcctaccattcttggcctctcttaattttcttctgggccactttcacattttgttctccagcctttcttattttccacactgtttcttgggtggtctccactttcatggctgaacttaccaggtatgtgctaatgatgctcatacctacttctaaccctgattttctgttgagttccggtgcttactgggcatttccacttgtgctcattctgccctcaaagcagttatgaccctggatatgtagggtctaagtgctaatgagcctgaatcctgatacttccaaagactagttatttgctctctgagcttcagtttcctcgcttacatatgggaaggataacagttattttaaggattaaatgatagttcatgtaatgtttatattacagtatacattggtggtagttaacatgtctagccattatcactattattctttgtataaataatttctccctctatttcataaatttttaaaaattgtcatgagattatgtaatcaaaaggtgctgccatttttaatttttaattttttagagacagagtcttgctttgtcacccaggctggtgtgcaatggtacgatcatagcttgttgcaattttcagccctgggttcaaagtgatcctcctgctacagcctcccagtagctaggacaataggtgtgagccatcatgcttggggtaaaaaaaaaaaacaaaaccatatatatatatatatatatatataaaatatatatacaaaaaaatacacacacacacagagacagagtagagatgcccagggtggtctcaaactccagacctcccaaagtactggattacaggcgtgagccactgcacctggccaaggtactgttatttttattaatcttgtatgtcattatagtactcttttaaaacgctagtacccggccaggcactgtggctcctgcctgtaatctcagcactttgggaggctgaggcgggtggatcacaaggtaaggagatcaagaccaatttggctaacacggtataaccccctctctactaaaaatacaaaaaaattagctgggcgtggtggcgggagcctgtagtcccagctactctggaggctgaggcaggagaatggcgtgaacccgggaggaggagcttgcagtgggccgagattgcgccactgtactccagcctgggcagctgagcgagactccatctcaaaaaaaaaaaaaaaagaataaataaaaaagtataattagattttttttgtaacacgaagaaaggatgaatgcttgatgtgatggttacatcatttaccctgatgtgattattatacattacatgcctgtatcaaaacatcatggccgggcacggtggctcacgcctgtaatcccagcactttgggaggccgaggcgggcggatcacgaggtcaggagatcgagaccatcctgtcccacatggtgaaagcccatctctactaaaaatacaaaaattagctaggtgcggtgggacacgcctgtaatctcaaaaaaaaaaaaaaaaaaaaaaaaagctggtacctatacgcaagtgtatcagcaatagatgagtggacctgtttccctatattccccttctagtgttagttttaattatttgtgatttgtttggtggttcactggatataaaggaataccttatggattttcattaagaaaattaatgaaaaattaataaaaagctaaatattaaatattggcttgcattttggtttcttcttgactgattgcttgatcactgggtttctatttctttggttcccactaggtattgtataagcttaaaaattatcctctggtattttgagtttactcccccttttgaaaggactttttgttttaatctctgtacttcatgtcattgctcctctattgtctggatcttaacggccccccagccccattattgagaactgtatttacagcaagccccttaaaaacaaattttatgtttgtttttacaatatacagttaatttcttagtgtcatcagctataaatggagttatgagaaataagtgaaaattgttcaataaatatttcagtgcctgtgaagtgccaggctcaaaaatgtttaagaactgcctggcacatatgagatcctctgtaaaagtagtagccattgtgatgtaccataaagtttacttttcataatttgggaggcagtagcatgatggaaatagggtggcatttgtgtgttcttccctagccacttccctactgtgttacctggatcagttactgtctctccagctcagattatttgtaaaagatgatataacttacaatacaagattgtgagggtcaaatgcaaatgtgtgaatacatttggtaaagcaaagtacagatgctaaaacccttaaaaaacaatcttttcttagcaccttcctttgcaaatatagattgcattattgttttgtaacagctttattgagacataactcacccacttaacgcatacaagttaatgttttttagtatattcatggagttgtacaactgtcatcacaatcacttagaatattttcattattccacaggaaaccctatacctgttagtaatcacttctcatttttctctcatcccgctagacctaggcaaccactactgtactttctgttcctatagatgtgcctattctgggcatataaatggaatcatacaaacgtggtccttttttgggactagctttttccctcttagccatgttttcaagatttatctgtgtaacatgtatgagtacttcatttctttcttttgtcaaataatactcattatgtggggaatattaccttttatttattcattcatcagttgatagatacttggatgtttctgagttttggcttttatgaataatgctgctgtagacatttatgtacaaattattctgtgaaagtatgtttcaattctcttggatacatacctaggagtagaattgttgggtcatatggagctctgtgtttatccttttgagaaactgtgagactattctccaaagtgtctacaccattttacattcccaccagcaatgtgtaaggattctgattttgtcatatccatgccagcacttttgttttttgagacagcgtctcactctgttgcccaggctggagtgcagtggtgcagtcacagctcactgcatgatagccttgacctcctgggctgaagtgatcctcccacctccgccccccaagttgctgggaccacaggcatatgccaccatctctggctaatttttttgtgtttttcttttcttttctttttttttttttgttgttgttaagacaaggtttcactacgttgtccaggctggtcttgaactcctgggctcaagtgattctctcctctcgccttggcttcccaaagttgttgggattacaggtgtgagccaccatgcccagcctttcccatcccttcccatccctccttcctttttgagacggggtctctctgtattgtccaggctggacggggactcatggattcaagcagtcctcctgccttagcctctctagtggctgggactgtagatgtgtgccactgcgcttgcctcatttggtttttttttggagacagtcttactctgtcacccaggctggagtgcagtagtgcaatctcagctcgctgcaacctctgccacctgggttcaagcaattcttgtgcctcagcctcctgagtagctgggattacaggtgtgtgccaccgcatctggctaatttttgtatttttagtagagtcggggttttgccatgttggccaggctggtctcaaactcggcctcaagcacttcacacacctcggcttcctaaagtactgggattacaattacagcagtctactgtgcctggcctcgcttgcccattttaaaattgtgttgtttgtctttattactaagttgtaggagtttcttaattattccatattcttgtcttttttttttttttttttttttttttgagacagagtcttgctctgttgcccaggctggagtgcagtggtgcaatctcggctcactgcaaactccgcctcccaggttcacgccgttctcttgcttcaacctcgcgagtagctgggactacaggtgcccacctccacgcccggctaatttttttgtttgtttgtttgttttgttttgttttttgagacggagtctcgctctttcacccaggcgggagtgcagtggtgcgatctcggctcactgcaagctccgcctcccgggttcacgccattctcctgcctcagcctcccgagtagctgggactacaggtgcccgccaccacgcccggctaatttttttttttttttgtatttttagtagagatggggtttcaccgtgttagccaggatggtctcgatctcctgacctcgtgatccgcccatctcggcctcccaaagtgctgggattacaggcatgagccaccacgtccggcctctgtattcctgtcttttgagacagggtttcactctgtcacctggctggagtgcagtgctgcgatcactgctcactgcagcctcgacttcgtgggctcaggtgatcttcccacctcagcctcctgagtagctgggactacagacgtatgctaccacgcctgactgatttttttgtattttttgtagaaacggggatttaccacgttgcccatgctggtctcaaactcctgggctcaaatggtctgcctgcctcggcctcccaaaatgctgggactacaggcatgagccactgcgcccaaccttgtacataaatcttttatcagaaatatgatttgtcaatattccattctttgggttttcttttcacttcttgatggtgttattactgaaggatgaaaacttttaatttgaagtgcaatttatcttatttttcttttatctcgtgtttttggtgtcatatctaagaaagttttgcctaatccgtggccacaaagattaactcctgtgtttttttctgagttttgattgcctcatttttaatgactatttcactggatagataaaagaaccttggttcagatgagatcattgttgtttattgttggatatttaggaaccatgtatttgtggatgacctggatagtttgttctgtggttttccccacagtgtcatcttcctctatatttagacatttctttttctattataagctctttggacattattatatatgactttgtgctcagtataaacaccttagaataaaagaataattggaccaaggggtatatagattttaacacctttttgttatcagtggccagaaaaattaccccagttgctattttaccagcagttccagtcagttttatgttaatacattttaaaacttgttttattaggggtaaatttggacatgcagaaattgaacagtataatgaaactatcagttacccagctctaacaaccatacactcaaggccagtcttgtcccacttaacttccccatttcccacttctcttctatattattactatttaaaaactctattgaatcacaatagaaatacggaaaagtacatacaataagcagattttcataagctgaaatccacctgggcaagcagccatcacatgtctccttgtgtccacttccagtcacaccctctctaggggcagccggtattctaacagctaacagcactgattagttttgcccagttttgtttctattaaatagagtcttacagtaggtactcttgtgtctttctcttggcattgtttgtaaaattactgaagtcattgcatacagttgattatttgttactgttgcttcacaaaattttgtcatatgaaattgttctgttgttgatggacattggatagatggtagttttgggctgttacagatattgctgctctgaacattcagtttgtatcttttggtcaacaacatacgtatgcatttctgttgttcagtatacctaagggtgaaattgctagggcatagaggtatatgtatagtagtggcatctactaaagctattgtaccaaattaggcttccatcagcagtgtgtgaaagttccacttactctggatcctctccagtatttcatccttttcattttagccatgctggtagctgtgtagagatgtcttacttagggcaattttaatttacagtagtgaggtcatacgtttattggtcatttggatatccttttttatgaaacatatgtttaagcctttttttttctattatcttttttctgtttttattacctttctattttttgctgcataataaattatccccaaacgtagtggattaaaacagcaataaacattatcttgcagtttctgggagtcagaaacttgggagtggcatggttgtctgcttctggcttgggtgtgattagccctctgaagccttcatggatccgctggaggatctgttctaaggtggctcatttacatgcctggcaagtaggttctggttctggctgttggtgggagacctcaggtcgttttcacatcggcttttgccagggatgtctgagtttcctgttctcaggacatggtgataacttcccactgagagagtgattcaagagaaagagcccctaagtggaagctatcatttttgtgacctagtcttggaagtcacgtagcatctagctttgccatgttctgtttgttagaagagaggcacattgtggacttctaaaaaagtgacagggtcttattctgtcacccaggctggagtgcagtggtgcgatcatagctcactgcagccttgaccttcctggctcaagggatccccccacttcagcctcctgagtagctagctgggcccacagttgcgcgcaccaccacacccggctcagttttgtatattttgtagttggagttttgccatgtttcccaggctggtctcaaactcctgggtttgagcattcctcccacctcggccctccaaagtgctagggattataggcaagagccactgtgcccagctgagatgtattttaaaacaacagttagtaggatttttgtattttggacaggcatctcttgtcagatgtatatatcgtgaatatctttacctattctgtgggtcctcattctgtcttttgaggtgaaggagttctattaaatctttttttctttattgtcaattttgtccattatattttgaagatattcaaataattattgcttcttctataaatatgttagtatatgttctcagagaataaggactcttaaccgtaacaaccacaaagcctcacatcttaaaaataaaatgaacacacatttgcttgatattattcaatacttagacttgaaagttctagtttcatgtgataacttttttgtgtgattttctaattttggcagtggcaaatcaggatccaaataagacctacctttttttttttgtatatgggttcctcattttttgctcttctcccaccatgccttccatttgtgggaggactgggctcttttgttttgtggtattccccacagtgttgtgtagcctctgttttatgtgcactggtagttggatcttgaggaagtttctcttggagaatacactttgttggactttcactttaaaacttttttatttttttgagacgaagtctcagtctgttgcccaagccggagtgcagtggtgtgatcttagctcactgcaacctccaccacctgggttcaagcaattctcctacctcaccctcccaagtagctgggactgcaggtacgtgccaccacgcccggctaatttttgtatttttagtagagacagggtttcaccatcttggccaggctggtcttgaactcctgacctcgtgatctgcctgccttggccacccaaagtgctgggattacaggcgtgagccactgtgctcagcctaaaacttttatctgaaaatggtgctgtttctttggttgtgatctgtctctggaggttgaatgtggagctaaactgaaatttttaagggcttctaacctaaatcacattgaaattcatttagaccagagctgttcaatacttgaagggtgagggttcattttggaaggcacttccgccgccttccttttctgtgtgtacgggaggccagtggcagtctggtcatcttgagtgcatcacgccctcactggcagttcagaatgttgcagggcatcgttagcatggattttgctgttgttagttttttcatgtttattgtctacttgttttctcctcgtgctgtctgctggctttccttctcttgttgccagttttggagttgtgatgaacaatatgttaagggttgataactcaaaattcttaagttctttgtgggttaacattgaatttgtagtgttctccagtctctttcttttctaacagaaactttcatgatgaaaagttagaagaataaattacaatgtgattaaccctgcacattgaagaagtagacaaattattagtattattttgagacagggtctcactctgtcatgtaagctggagggcagtggcgggatctcggccagtgcaacttctgcttcccaggttcaaatgattttcgtgcctcagccccctgagtagctgagattacaagcacgcaccaccacacctggctgatttttgtaattttagtagagatggggtttcaccatgttggccaggctggtcttgaactcctggcctcaagtgatctgcccgccttggcctcacaaagtgctgggattacaggcgtgagccactgtgcccagccttcaaattatttcttaaaatgcgtgtgtatccagagtttaaactgaaagagttgttttcttaattccaactgtatttttaaagtatcattcaacttcaagtaataattaaatttttcatgttttgtttataagtgaatgtatgtaaatgataccaatttttggccactaattcattcagcagataccttgggtgcctacccggtgccagtcctagcgcttcctgtgctttggtcatacagtaagtcctcacttaacaccattaacaggttcttggaagctgcaaacttaagcaaaatgacatagaactgaaccagttttgtctgcctcatcagtgttataatggaatggtgttattcaagaacctgctgtatgttgttttgcttaaagtcgcagtttgaaaaaacgtgttgacactattaagtgaggacttactgtgtacatggttaaagatgatggacatggtgctggtaccctcatgaaatgctcaggacagtgtttctacgaaagacaatgcaggctatgtatgtaatcttaaattttctaatagccacatgaagaaagtaaaaaacgcataaaattaattttaatatgttttatacaacccattatgtccaaaatattatttcaacatataatcagtaggaaaattgagatgttttcacatttttatactaaatctttgaaatccattgcatattttatactcttagtacctcttagaggaaactagtcatatttcaagtgctcaaaagccgtatgtggccaccatagtacagagcatatatcagaattattatcattattgttcatgctcacatgggagttgcagggggcgctaaccaagaacccaagtaaacagtgggttggaggggccagaggagactgggagatgaattaggaagctgtgtccaaagggtatcttaaaagatctttatggatgaatgcacactccagtttaccttattccaggttgtggcaaaagatgcagagaagggaaagtgtaaggcggaactgacaatgttttggtgaattggattggaagggaaaagaggagccagggctgttttccaggctgcctttcacaactagggtgtgccttttactgagatggggagggcatggtgaagaggaggtttggttggatgggcagcttgtgatggagagcaaaagctccattttggagattaaataccatgtgcttgtgagataaccaaagggaaatgtctactagtcattgggttacctgtgtttgaaatgccatgatggttgttttggttttataaatttggaccttagttgtgtttatggagaggaatttttgtttgtttgtttttgagacggagtctcactctgttgcccaggctggagtgcagtggtgtgatactggctcactacaacctccgcctcccaggttgaagtgattctcctgcctcagcctcccgagtacctgggactacaggcgcacaccaccacgcctggctaatttttgtattttttagtagagacaggtttcaccatattggacaggctggtctcaaactcctgacctcgtgatccgcctgcctcagcctcccaaagtgctgggattacaggcgtgagccaccgtgcccggcctggagaagaatattttaaaaacccacggaaacggcttcgtttattcaacagaacttgtcttgaatctcccagcgctttgttttagttgctggggaaacagcacaaataaaacaaatgtgaatttacttcgagcaaatgtgctgcactcagggaagtgtgctaggtccacagcctgacctctgtgggagcctctgtgttatcagtgggacagaagaaggaaggaaggaaggagaggagcagccctccaactagggagactgagaaatggccagtgagaaaacaacgagtgtgtgacatcagagaagccaggcgaggagaatgttctaatgaggagcgtcttctgggggactgccttgcatgctgctgagagtgaggtgtacgtgaggacagaagagtttcatttggatttagccttgtctggaggttgtcagtgacctgaaagagcagtttgagctgagtggtagagagatcgcagattggaatgaggtgaagagggaatgctatcagacaaataactttttctttttttaaaataacccctacaaatcattgagaagaccaacccagtagaaaagtagacaaaggatataaacagacagttggcagaaaagtgaagtataaatggttcttcaatatatgaacagtgcccatcctcactgaagagaaaagcaaatgcattgttgaccaggtgtgtggaaacaggctttcacacatcactgggggaatatgggtagggctgacctccgtggagagccacttggccatgtacctcattggagagccacttggccacgtgcctaattagaagcgcacattctttgatccagcagatccacttctggaaatactggcatattttgtaatagcaaaaagtgaaaactaaatggtcatcagtggtggcctggttaaatcagcagtaaaacaaaggaatgtctatatcaggtaaagcattatattcttgaagaaagtagaaattgttttttttttcttactatgctctaagtcaggttctttgagagttactttttttcattaaaatttttcaagattgagaaatatacaggtgggtctggtataggccacacaatgtatatagaaaggtgcctttgaaaagagctgtgtagagcttgtccttctgccctgaccctctactttttcacgtttcacttaagtcagtaggctatattcctttctccagatacctgttaggattctttcgagtggattctttcctatttcatatatgtactgagttatacgccataggaaaggatatcttacaatatctttatggatgaatgcacacttcagtttaccttattgcagctaaaagtaagtgtaccccctgtcaagagagcatcccgttttacttggtttggctcattgacaaagtaagcaagctcctggtacaatttgagagccctgaaagcagcaatggggattctactatagctgtctagtgtaggaagattttcttggtcaagtttttgttgggggaaagaacagtccaaacctttgtgagctgtgtgttctcatcccagctacacgcacctgactgtatagaactttttgcagtttggccttctttggagatagcagtgtgtttttacgtgtggactaaagcaaaaatgaaaaactaggcacgtgccagtagaccaaatcagcctcctagcagagcacattgacattgtacaactttacagcctctgtcattggggtctggtttcaatttacttcatttcttaagagtttaaactggtttttataatttttccttatttctttgagtatcttggtttcacttatttgttcttttctatgtcttcttagatctaaaggaatgaagaattttaggatttgaagtgtcttaagtaatcatttagtctaaacctctcatttacagataagaaaacaagctcagagagatgtggtgacttgctcaaatagtgacagaacttcctcggccatatggaggggtcatataatacccttgtgtcttcagtttgaggtacctcccataattttaaggggtatgtggctttaattacattactactgtttgaatgaagaatattaatttatatgctgcactagttcatttagaatcgtggacacaatcgagttgaactcttacattttttggttgagaaagttaagacctagaagatgagaatttattcatctaagattacaggccataaacatttattctgtgcctagatttttaaaaattgaattattgttttttatttatttagagagatagggtcttggtatgtgtgtgcttagttttaacgtgagtcagagcagtgctgtctagtagaactttgtattaggttggtacaaaagtaattccagtttttgcaataaaaagtaatggcaaaaacctgattacttttcaccaacctaatataagtagttaaaattaatttaaaattcagctcccaggggagtggggtggaacaacaacaaaaaaccagctcctttgccttcctagccatgtttcagatgctcagtaactgtgtgtggctgtggaactggacagctcagccgtagagtgtttccctttcttgttaatctttttttagaaatgctaacggtggagactaaggcatacaagtatgactagaattgccagctacacattagaaggtttaggttcaaaactgggagtaaagacttaactcttggagcttgggatagtgctacaactagtcctggcctgagccttttcttcattcatgttttatcctttttttctttatttttggacactgataagaacctgtatgagattgtttccttttttccccccgcgttgtaggtatcttgttttgccagtttattaggttggtgcnnttnnttctctctcttttcgccccatcttttccttctttccccctcctcctttcttttccctctctctggctctccttctttctcactatctttttctttttcgctctcttcttctatcctctccctcttctcttctttctccgctacctatcctcccctttcgtacctttccctctctcctctctcctctctactcgttcgttactctccacctccttttgattcccttcctctacctgttctattctttcgccacttcctctgtgttccttcggttcgcctaccacctcctttatccctttgctttccttgacttctcatcacttctccagtgcctatctcgcatcctctccgttctacctttactctcctaattcgctctggtgtatcttctttgcgcgttcttctgtttataatcttacttctgctctcatcttatgtccttttcctctggctctcctccctgtctctggtcttccactaagctcttatctttactgttgtccgtcacttcgctactacttcctctttctcttcactcaccttgcacttttcttccgctccttttccgaccagttcacagcttatgttctctgccctaccatcttctgtcctctttcttactctataacgctatctcggtgtttctgccttccgcgctgctgcttcactcgcctcgccgctctcacctgtaatctcctgtctcctccagctctacgtgcctctcacatgctattctctatagccatcctctcgcgtgttccgcatactatcactaacactctctatctcacaatatcacctcttcggtcgagtacatcacttcttgtacgctccgctccgcgtctctgctctcgtctcgcgaacacatatactatactgtcgatctctctcc

SEQ ID NO: 19 - DNA, 73065 bp, Homo sapiens
  unsure (67), (72254), (72257), (72258), (72259), (72260), (72261),
  (72263), (72264), (72265), (72267), (72268), (72269), (72271)
  (72272), (72275), (72276), (72277), (72278), (72279), (72280)
  (72281), (72282), (72283), (72284), (72285), (72286), (72288)
  (72956): Identity of nucleotide sequences at the above locations are unknown.
tatttagcgcggttacctcttgcgctttgctagctcattgcgcacgtttgataaaccatgtactcanatcatagcctttttcatctccggcatcctcttcagggcgataaaaaaccacttccttccccgcgaaactcttcaatgcctgccgtatatccttactggcttccgcagaggtcaatccgaatatttcagcatatttagcaacatggatctcgcagataccgtcatgttcctgtagggtgccatcagattttctgatctggtcaacgaacagatacagcatacgtttttgatcccgggagagactatatgccgcctcagtgaggtcgtttgactggacgattcgcgggctatttttacgtttcttgtgattgataaccgctgtttccgccatgacagatccatgtgaagtgtgacaagtttttagattgtcacactaaataaaaaagagtcaataagcagggataactttgtgaaaaaacagcttcttctgagggcaatttgtcacagggttaagggcaatttgtcacagacaggactgtcatttgagggtgatttgtcacactgaaagggcaatttgtcacaacaccttctctagaaccagcatggataaaggcctacaaggcgctctaaaaaagaagatctaaaaactataaaaaaaataattataaaaatatccccgtggataagtggataaccccaagggaagttttttcaggcatcgtgtgtaagcagaatatataagtgctgttccctggtgcttcctcgctcactcgagggcttcgccctgtcgctcgactgcggcgagcactactggctgtaaaaggacagaccacatcatggttctgtgttcattaggttgttctgtccattgctgacataatccgctccacttcaacgtaacaccgcacgaagatttctattgttcctgaaggcatattcaaatcgttttcgttaccgcttgcaggcatcatgacagaacactacttcctataaacgctacacaggctcctgagattaataatgcggatctctacgataatgggagattttcccgactgtttcgttcgcttctcagtggataacagccagcttctctgtttaacagacaaaaacagcatatccactcagttccacatttccatataaaggccaaggcatttattctcaggataattgtttcagcatcgcaaccgcatcagactccggcatcgcaaactgcacccggtgccgggcagccacatccagcgcaaaaaccttcgtgtagacttccgttgaactgatggacttatgtcccatcaggctttgcagaactttcagcggtataccggcatacagcatgtgcatcgcataggaatggcggaacgtatgtggtgtgaccggaacagagaacgtcacaccgtcagcagcagcggcggcaaccgcctccccaatccaggtcctgaccgttctgtccgtcacttcccagatccgcgctttctctgtccttcctgtgcgacggttacgccgctccatgagcttatcgcgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacatgagaattggtcgacggcccgggcggccgcaaggggttcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagcttttctgagaaaggtggtaggtgtttaacgtgtcgggggtagggggatctttttccatggtcaagttaagtctagaaaatgctgcaaatgacagctcctgcacactttcttgaaatgctctcattggcagctggccaatgaatgttccacagaacctagtatggcttttcaaattgctctaagatcatgtttcctaaatatttgtgtcatgggccaacgtggatacacaggtaatagtgaaattctaccttctagagaaatgttaaagaaaaggataaacaactgcttttctgagaaaatcaaaccatgacgtaattttagaggcctaactagtcatctgataattctggtttaaaacagccatgcatgtgtgcacactcacagaagtgtacacatgtaccacctggcaagcagcttccataaaggaaagtctgatctaaaaactcagtcatatcacatggccatttcttcttagttaggacataaagataaactgtgtggtgaaatggcccaaggaagaggcttatacctcttatgcctctctcaagaagcaaaattagaagtgggcacacaccactttttccatccctggtgacaactgtggttttagtgcacattcaacagggaatagcctcttgaacaaacaaacattcttaagaaaaaatggaagacccactgggaaatgattttaactgaacaaattctgtaccatggatgttaaagactgttcacattcagaataggtctcaggattggtaatcctgttggtacaaaaacccagagtacacagttctctcattttagaagaaggctcatggcttggggccagtgtaaaaaagcatccatatagtttcttccaaataagcttgggctgattaaactgaaatgctatacagaaagagtcctttagaagccaatacccctcattttagtgacagcgacatcaaagaaatgctgataaatgccctaatattccagttaaagaaacttaattcagaggctatatagaggccttcagaaaataaaaggcaaaattatagctgaagtggctcaactgctagcatatgagtacttcacactcacaatactcaaaagcatgattcaccaagcaatgctctttaagaatgacaataggtgactcttatatgctgaatccagccaagcctgccaatgcttatggaatggtctgtaactacatgaacataaatacaaccaaaaaacaacactgttcaaacacattctcaagaacctcattcaaatacataatttgccaaatataaagaagtcccacaaatcactattaaaaatgctacatgcatttctacttgacccttaaatccttcctgcaacccaacaaaaatgtaattcaaatttcacaaataacttacctttgataagctgctgcactaatgcactgttggggcccttgtcagtgctgtgcacgatacagttagctatcctcgttaggtgtcccatgtaaccatgccgtcttcctccctcagccctgacaagaggtaaaggacaaatactcagattcctgataggatgaagtgatgaaacactcggtaaatactgcggacttttaaacaatcattttaaaccctgaaggcactgaagaaaatgacgatggacagaaaagaaaagaaaaacaaaggaatggaaggtgccagaatatgaccatgcagcatggtcagggaggggtgtgaaattgtaaaagattatatggcagcctcagtcaacaggccacagtttattcgaatctcaaaaatcatcactcactgtcaataacacattattttttaaaagatcaaataaaccttctctgatgcctaatgttattgtgattttattttacatctttttaatgaaactttttcaaaccttaatcagattataaggaactgaggtaagaattctgctggttcattttcttaaaagatagcaaatttttattatatcaatgaatagaaataattatctaccaatgacatgtctcaagttaagatattagctgatgtgagacttggccaagataggagacagtcaactagtacttgaccatacaccattctgaacacatgcaaacaaacagtctttgtccttttcccatttaaggtctcatcttcccaaccatgatcaatctttacacttaattcgtatcaggccaggcacagtggctcacgcctgtaatcccaacactttgggaggccaacacaggtggatcacttgaggtcaggagtttgagaccatcctgggcaacatggcaaaaccccatctctactaaaaatacaaaaattagccaggcgtggtggtgcacacttgaaatcctagctactcaggaggctgaggcaggaaaatttcttgaacccggtaggcagagactgcagtgagccaggattgtgctactgcactccaacctgggtgacaaaataagactccgtctcaaaaaaaaaaaaattatatatatatatatatatatatatatatatatatatatatatataaaataagtaaactcatattaatctgatttctctacctatttacaaagtgccaagattttaagctctatcaaacgaaagatttttgactgcagatagcagggaacaaacactgcagagatttttgcttagagagagaaaagcctttcaggagcaataagaaaaaaaaaacatcctatgcttgaaggcttgcttggaaaataaagtatctgctagaaaatcttaaagggcttgggggtgcctaagggtaagaaagtacagggttgattatttaggtagagacaaggtcttgcttgtcatccaggctggagtgcagtggtgcaatcacagctcattgcagcttcaaactcctgggctcaggcaattctctcacttcggcctcttgagtagctgggactataggcaagtaccaccacatccggctaattttttgtagagccaggatctccctatgttgtccagactggtctcgaacccctggcctcaaccaatcctcccatctcagcctcccaaagcagtgggattacaggcatctcccaccgtgcctggccagagtcaatcttcactgagttgctcagagtctcttttagttcttcagtaagatccagagagccaggtgttacctacaggcaactgagtcactcttctgcacaccctcaagtacacaagtgaaagaaaacaaaggcccatctctaaggtgacccacagcttcaaactgcttcaggctgttgtgcaaggaaacaaggaaagttctttcgggatccccctagacagagggaatggtattcaccaggcctccagaaaacgggactcaccaggagagcagggcacaaaggatatctgagccctggccagatgaggaggcagcaagaagactggaggttgggaaggacacagagaagccaagacggagtcagacatataaccagagatgtcaactgggccacaaacagcatctccaaagagctccatttggaagaatgtatctgaggtctaccaatactagccccttgccacaaacaaacaaacaaaatgccaatttcccacatgaagccaaatcaaaaccctagtagcagtgcttattaaacgatttaaaaaaaaaaaatcaaacctcacaaagtaaggctgactcccaagagtcatctagctttcctggagacacagagacacataacaagaatgctgggaaatgatcaactacaaaggaccatgagagaaattttgggggtgacagaaatgtcttgattgtggtgatggtgacttcaggcatcagtcagaattcctaggaatgtacacctaaaatgagctttaccatatgagaattatatctcaataaacctgtcttaaaaacaaacacagaagcatgccttcagagtgtttcccaaacacgcccttatgccaccatgcttcagaatctacggggtgacataaaggctcccagggcactagagaggaatgctgttacagacaacacctgtaagaaaacgttttgtgtaacaaagctacttacatgtatcaactaatacttcacataaccttgccaatcagctaacaaacattttctaaaaagaaaacactgagcaatttttttcctctaggtccctgtacaaagcaactcttctctacaatgaaaatatgtacgtgataccttctgttctgagcataaggtgaccaggacaaatacactaagtcacatcatcaaggacttaactttaaccttataactcttagaacagtagccattcaaaaaggaccaggaagtttcaaaggcagcacagaggtggggaacactccgaactcacttgttttgccccaaaaacaagaggacctaacaagaaattattagtattataaaaacaactgttacaatgaaataatctggggaaaagtttaaattgtaaaatggccagtatcatgtaattatttccatttttttctgactagggcaaggaggtattattttcctcatattaccaaccaaactgaattcctttcaaaaaaacaatttacttactgtttcttctcattcatttcccaggcttcaagtattcgttctattaattgacatttttggaaaagctgaaaaaaaaaaaaagaatattccagttaatacttcaaagcatcaaaactttaaagtgaaacagaactctaggttaaagagaatagtagtatgcataatctagcaagctaaatgttactaagccaaatgcaatgtgatcatcaatctactgcagacacccacaacactacagagattcaaatcaggatccacaccctccacagaacatctacaggaaactcagtattataggtagtgcagttaactacctatagttaactataaaggaaagccaggttttattagctgtgaaaattcagaacagaaatataaaacctgagctaaattaaaatggaataaagaaaactatgccttggcaaaaatttaacttagaatccaaagtaatgcttgtacttttaaaatgtgagcacgtcttacttccagatgaactaacattactgcattaatattaaaaacaggtgggttttgcccaaagtctgcaagtcagtgacaactgctgtaggctgcaatactggaatgtgcagggctagttcttctcaggtgtcatttgtctttcccatcaacttggctgttccaagctagccttttctacattttaggtttgcgagtaaaccaagtgtgggctagaaattttaaaagtaccatagaactaccaagcaagaaaaaatctgaagactgacttagtaaaattatctcatatttgacagaagagaaaaagagaccccaggaagactctcaacatcacaaagaactcagttctcctgactttcagtcacgtattcagcaaagaaactacactctggtcagccaaataatagtgcaaatgttttccatagtatttacatttctatgattcttcaaatcatcaaagaatttatatatcttcaaacctattaattttaccaaataaggaggccacttagcttttttcttacaagactgttcatttaatagttatttgtccagtacttgatttatataatgatttatatgttaaaagtgaaacgaacacatgattgtcaaatatttagactctgaaatctaacctcaagccctttaaacctcaattcacatcacagtcaagtggaaaactgctataaccaggagagagtgggagaaaaacgagaccaaataagcttacatgttttaataacaaattatcaccagtggagtcttgatcggtaattgtggcattttctgtgttttcaaaaggacttgcaagaatcagtgcaatacaaatttccacttgtgtatgcaaaaagttattccatgtatacttgaagaacatgttctacaaaaaagaaaaaccatgttttattcggttacctcaatgtttaagccaatacttaaatacatttacagaacagtgatttaataaagtaaaaatgatgtgctctcagtccaaaaggaccaattaaaaggaacctgagttcacattagtacttgcataaccacagtttcattttctgtggtttcagttacccacagtcaaccatgatctgaaaataggtgagtataatacagtaagacatgctaatccaagagatgacattcacataacattcattacagtatagatttataattgttctactttattattagttattattaatctcttcctgtgcttaatttataaattaaactttgtcacaggtatgtataggaaaaacacatagtatatatagggttcgatagctgtggtttcaggcatccaaaggagtcttggaaggtatccctcataaataacgaggactaaatggggatgtgaagtattgctttagagcctaaatggcgtgctatctgcttatctgacatgccagaactggtatggaatctagtaaaaaaccaacaacaaacatacaaagacaagagtacgtttctccaagagaaagggagtatcttttttctcttcaaagcaactaacacaaatagttagcgtggtaaattttctataattttcaaaaaaatttataagaggccaggcgtggtggctcatgcctgtaatctctgcactctgggaggccgaggcgggcggatcacgaggtcaggagatcaagaccatcctaacacggtgaaaccccgtctctactaaaaatacaaaaaaatcgctgggtgtggtggcgggcgcctgtggccccagctactcaggaggctgaggcaggagaatggcgtgaacccaggaggcggagcttgcagtgagccaagatcactgcactccagcctgggcgactgagccagactccatctcaaaaaaaaaaaaaaattgtaagaatttcattttgatgcaacaaatatttactgatggtttttgtgcagggtattgtatgagatgcaacatggcagacagagatacacaaaaatacggtccacagtcttgaggtgctcatgactcaactccagcatacaaaaactagagctatcagcaaaaacaaatgaggatacgagaggcagtaacgtgaatctcctggaagtacaagggttttcaaattacttgaaaaggtaatagcattacaaaagggaaagaatttctaaaagtacaaaatgccatattttggaagtcaatttagtatgtcatatttaggaaatggttgggtctggttatctaatctcaaaatgaagaagtaatgagtaactcctccagtagtctcatcaaatttagtctcatcagaagtagtcctaaagattaacagaataaattaacaataactgtatattgttattagtaaaattaaagaccagtgatcaatgacttaggaacgttatattcccggagttttatacactagaaggtaggacaaaaactacgtccccagaaggcaatgaccatgctagctatcaaagaaactgtaattctttaaatcttcatctctttttccaaattgctcctgttttctgtgctctatactgatttaacccaaagctgaaacctaacaaaaatatctcggtgacgctaggaagcacaatgatgtggttgataaagcacgtatgggtttgaaattgggtgaattcaaatcttggcttcaccgctcactagccatggaatgtatcctctctctgggcatgatctgaaaaacacatcctctctctcactgtaatgttcacccgagggtcctggagatcacccaggatcacatgaatagtgtacataagatgaacattacaatgcctgtcatacagtgaacaaacacctcctttgaaacacccccacatctcccccaaatatatgatgtgaccagatgtcttgtgaaacctgctaaagtgttaaccctcgcgctttctgtgctgtgggtggcagcacacagagaagaagcatgggctccagagctgggcctatggattctaagcacagactctgaaactggggaattcaggggtcagggagacctaaatcatccctgggcttttccttctccttccatcagtaagcaggctaataactgtgtctcaaggaagagtcaatccagactcaaatcaattaagaccatatggcgtcaggtacgttatacagatacctcccagtggcaagaagataaaggtttgtcccctcactaaatatgaacagaaaacaatgctgcacccagcagtcattgtccacgagacggagcacgagggaaaagccgatgtctcttaatcatcttcaaaatcctatgttacaattctttatataaagcaacagtagatgcctagtgaacaattataagcattcgaaatttataataaactcaaggcaaaaactacataaaacaccatttatgctcagaccaagaaaagtcactgacataatgtaaatttgtaaggttgtaacttggttaaatatccatgaaatatcaatggcaaattaaaatgtctgtgagcagggaaaatctcaccaatatgactccaatgctattcagctccataaggtccccatttatactgctggtattggtttgaagcaggctggatatcaacctaatgacattcaaccgggtattccccacaggaggatccagcacaccccatgtggtcttcatcacacttttctgaagaagaaaaagctttccaattaaattcagttaaatgaacaaagcaaatggtgtatttgctaagacatgacactagtttaaaccctgcaaacaacatggcctgaattttacacctgaaacaacatctaaagctgctcttgatatctttaagatacaatgaaataaccaagcaggaaaaaggaaaaaaaagcaaggaatttccctggatcataaattttataagaaatcaagtgtctccctgcctcaacattccaagctgttatgagaagaaagcagaaggctacagaatatcctaggaaaaagtacaatatttcaaaatctgaccagaaatctaaactaaaagaagttatggccgggcacagtagctcatgcctataatcccagcactttgagaggccgaggtgggtggatcgcttgaacccaggagtttgagaccagcctgggcaatatggtgagaccctgtctctacaaaaaatacaaaaattagccaggcatggtgatgcacacctgtagtaccagttactcaggaagatgaggtgggagaatcacctgggcctgcggaagttgaggctgcagtgagctgtgattgtgccattgtactccagcctgagcaagagtgagacactgtctcaaaaaaacaaaaaaaggaagaaggaagaaaaaaggaggaggaggaggaggaaagagaaggaggaaggaggaggaggaaggaagaataaagaagaagaagaagtggtagtagtagcaacagcagcagcagcagcagcagcagccgtggtggtggtggtggtagtagttgctacaagtggttttggaatacaatcctcagtctgagccaaatctgtgataaaaatgcaaattcagacgttgcctctggatcacaaacctgaaatgtgatcaatctaaacctgttcttgtccatcaacaggagtttctatagcctgaaatcacaaaagtagaagcagaacatttcctaactttagaagtctgagaggcaagggtggcacgtaacagcctagggcaggctgccctttctgcccctccccatccacatcagtagcctcactccctctggctcccatcctcccgaggactcacagagctgtaaggcccacagttctgctctctatggaaaacagctctaattggcaggctttgtaaaaaacttcatggatctacttacagacacatcatacagtaaaaccaggtgcaaacggtactccgagacagacatatcatacagtaaaaccaggtgcaaacggaactcactcagttctcggagtaacagagaagtccaaacaagacactgccttacttttgaatcggggcccagaaccagatgccacctgtttgtccacccagaaagaagatgggtgggccacctaagacacaggtcaggcccttcctcacacaccttcttccctgtcagatccttctcccacctccgtcttccacttgtgatgttctctcctcttctaaatcttttctttttctttccttactctgtttttcttcccaggactggcatgaaggatgccactgaccatcattgtcaaacaccaacagaggcactttccctaagggcaagcaccaacactatggtccacatccaacacaggctgaatgcagataagatgtggctggaatggaaccagcagagtaacgcaaactgtgagcacagtgatggaaccacgacctgctcaccaatggcatcaggtatctgaaaagatgatctggagctgaactagactcccttggttatataagttatcctgtgctcccccaactccaaatagttaaataaacagaaaacatctaatttacaagtgagaaactagtattctaaattcccaataactcgcacagtagataaccaccgagatacaccagattcaatgatatagggcaggaaaaaaaaggaaacttaagaactgttgctgggaacagaactcacatggaactgaatcttccaccctagactccaaaagcaagtgattatcaccctaatctaaatctgtatcaatccaaggggcgaaagaacaccatttatagactgctgacaaaactcttgtgggtcttcactgaggaaacagtcatttaaaattagcacatgggaggctctgtactgaaaaacccccaaatcatattctctccaaattgtatactaacttcaacctactctttcttaaataaggtcgactatacatcagacatacactgctccaactctgagtaagaaaacataatttcaaagatccgtttctgaaagattagcttttcctgaaacattcaaaaataatatgctacaagaagaaaattcttttttctttactggcatgtaagtacccaagaatttacagaagaatgaaaaggtaaacttcctaaactgatgaatattttgtttaattctccattctccactcaaaagcagtaaaaatcactggcagtgttatcttttcactcattttgtacatgcagaccacagccagttctgccactcctaaggcccgtacacattcgaatgactgtttcaaccaaattactcgctgggcagccatgcttaacatagctcccctaccttgggtggctccagcaggagttcatgaaaagatccaagtcttcctctgatggcttctagaacactcttgtttactgaacaagctgaatggctcatgcctggtgggcagatctctatatggccttcaaatcttgaaacaaagcaaggaattttagttattataatttcagaacaaatcattcaagcttatcgaccatgtatgtctttacttaatgattatatcaacttttctggctgcgggaaaaaaggctaggaaaaaagcataatgaggcagaagagggttaatgaaacctccatgaggctcagactctataacctgcaacccaaacagctacagtatcaggtaagaaattacatgtgatttcttcccattctaaaccttctaagtcttcataactattatacagtaacaagtctctaagtgaccaggaaatttggaaagcgaaagggatccaacctctggattatagggcaccccaaattgcctgccagtttggggtgttattaatgaacaggcctatacttgttccatacagtttttcttagataatcaacattatttcctatttaaaaggtttaaaattattctacataaagttcaatctatactcattataacctacttcttgcaggaaaacaattacaggtagaatgagaactgggtaaatactcaaggataagaattctgggtgacattatgaatgtttaactttctaagaactgacaaacatttctatgaagtggctatatcactttccattcccaacagtaatgtgtgtgacttccagttgccctgcatactgcactgagtactgtctattctgtctgtctggtttagctaagtagtgggctgaatgatgctctcctacccaaaacatacgtccacattctaatacgtagggcctgcaaatgtcaccttctttggaaaaaagatctctgaagatgaaattaattaaagatcttgagatgaaagattatcctagattacccaggggggccttaaatgccatcataactatgcttcgaagagagaagaggcaagacagacacacagaggggaaggcaatgtaaagaggatgcagaggggtcacaagccaaggaatgccaagaactactagaagctggaagaggaatgccttagtatctctgaaaggaatctagcaccaccaacaccttgatcttagacttctaggactcagaactgtgagaggataaattactgctttgtttttgttgtttcctgggctcaagtgatcctcctccctcagcgtcctatgtagctgggactacaggcacatgtcaccatgcctggctttttttttttttttcggtagagatggggccttctcaagtgatcctcccccctcagcctcccaaagtgctaggcatgagccaccatatccagcctaggtattcttcatatacctggatgtaagtcttttctcacacgttatcaatattttctggcagtctgtgacctatcttttaattttcttaacagagtctcggagcagaattttaaaattttagtgtagtctgagttatcaacttctgttttatgaattgggttttggcaatgtatctaaacaatctgtacatgactctgagacaaagattttctcctgtttgcttctagaactactagttttatgtctagttctatcatccattttgagttaatttttgcataatctgcaaaatatatatcaaagtccaacgttctgcatagaatacctaaccattcaggacgatttactgaaaacgctgtcctttctccgctgaactgcccccatgcctctgttaaaaaccgcctgatcatggggatgggtctacttctggactctgctctgtcccagtgatctgtatgtctattctttcaccacactgtcctgattgctgtcgctttgtattaagtctcaaaatcagagtgtgagtccttttctcttgcaaaattgttttggctactgtactttgattcttgtgcaagttttagaattcacttgatttctaaaaaatcctgcttagattttgttcggaattgcattgaatctgcaggtccatttggggagaagtgacatcttaacaatactgagtcttctaatccatgaacagagtatttctctccatttatgtaggtcatctttgatttcatcaatattctatagttttggggcattaagccttgcacacattttgttaggtttgtatcttagtattttcttttctctatgctataaaaaataatacttcgaaaaaatttcaaattccaattgctcattcctagtacatagaaatgcaattaacttttgagtgctgacttcatacttgcaatcttgctaaatgtatttgttagttctaggagtatgcgttttttttttttctttaatgttctttaggatattctacaaagacaatcctgtcatctgtaaacagatgcagtctcacatcgccccctcccctctgaatgtagcaacacagactccatcgctacaaaacataaaaaaaatttggctggacatgatggcttgtgcctgtagtcctagctacttcaggaggctaaagtgggaagatcacttaggcccaggagatcaagtcaatagtaagctatgattgtgccactgcactccagtctgaatggcaggccttatctcaaaaaatataaataaaatgaaagagggctttatcagttttcatccaagttcccttctaatactaatctgctgagatgttttatcataaaggaatttaacaaaatgatgatatgttttttcttcattgatctgatgtgatcagatctgctgtctgttgatgtgaagattttgaaggatgaatgagccttgcattcccaagacaaaccatactttgttatgatatatattatccttacaatatactgttagacttgattcactcatattttcttgaggaattttacatttcagctcttgtggcattttgttacttgcagtcggccctctgtatccacaggttctatgtccactgactcaattaactggaaatcaaaaatattcagagaaagctgggcgaggtggttcacctagtcccaatgacttaagaggctgaggcggaaggatcattagagcccaggtgttcaaggccagcctgggcaacatagtgagactgcatctctaaaaaaaggtggaaaaaaatgccaaacaaaaaataatactatttaaaataatgaaacagcttaacatatatcatttacattgtataaggtataagtggccgggcgtggtggctcacgcctgtaatcccagcactttgggaggccgaggggggtggatcacaaggtcaggagatcgagaccacggtgaaaccccgtctctactaaaaaatacaaaaaaagttagctgggcgtagtggcgggcgcctgtagtcccagctactcgggagactgaggcaggagaatggtgtgaacccaggaggcggagcttgcagtgagccgagatcgcaccactgcactccagcctgggtgacagagcgagactctgtcttaaaaaaaaaaaaaaaaaaaaaggtataaggaaaccagagatgatttaaagtacacaggaggatatgtgtaggttacatgcaaatactatgccatttatacgagacttgagcaaccgcagattttggtatgcatgggagtcctagaaccaatcctcagcagatacagaggaacaaatatagcttttgttcccatgattttgtgtagttcactatagtttcaaagtgatgctggctacataaaatgagttggaaagagttccctctactgtattctgacagagttcttccatctttggtagacttcaccaattgagcctatctaggccaggagttttctttgttaaaggttttcaatataagttcaatttcttcaactgatatggggctgctcatgctacctatttcttcttgagtgatctttggcaattatttcctctaaggaagttgtccatcacatataaactgctgaatctgtttaatgcattgtttgtagtagtctcttattattcatctgaactccacaggaaacagtgttaaagtccatagcacacagtcattcctattatttgtaatttgtctcttttctacttttttcctaattgggatggaagtttatcaattttattgattttttcaaagaacgagcttttggcttcactgatattctgtattatttttctcatctcaagtccactgacttctgctctgaattttattatttctttccttctgtttgccttgggtttaatttgtcctgcctttacctttaatttgtaaggtaggagcttaaatcattgacacacattctttcttcttttctaatataaccacttaatgttataaatttccttctactgctttaacagcattccataatgcaatgatggccttgtagcatgagtagcaagagggtactgtaccgctggggtgggaagagggcaccgtaccgctggggtgggaagagggcaccgtaccgctggggtgagaagagggcaccgtaccgctggggtgggaagagggcaccgtaccgctggggtgggaagagggcaccgtaccgctggggtgggaagagggcaccgtaccgctggggtgggaagagggtactgtaccgctggggtgggaagagggtactgtacccctggggtgggaagagggcactgtatccctggggtaggaagatggtactgattttcctagaaagagacaggtaggcaaacaacccccaaactacaacatacttgaagcagtgccatcacactgcccttccattagtattgaccaaagattaggcaaagcagcaacagagatcaggaattggggaagcaggggttggttggtaaggttatcttcactattttgctagaaaccaaaattacaccgctaaaagtaaatccagaaaccctgaatggctgaagtttcatatgctaaggatgcactctatcccttgcttaatgaatgaattttggggtaaaaaatacaaaattccaacctctacatcacacaatcccggaaaacttatacatacctcttcagattctcatgctctaagagcagttagaaaactctgataatgagtaaatctgcactggacataaattataaagaataacatgacacacatgaaatggctggtccaggggcgaaggccacacatgtgaaaagcaagactttatttttgattataaaacatgtagaagaaatttgtcctcaaagctcaagccacctgcccatgcattttaagacagcctctgctcaagtgccctcaaatgtgaaacccaggaaaacaccacctgaaggcctaagtatctgcagaaaggaatgaaaggaatcacaagacagagagacgttctgaatggccaggagagctacccactgaccaggaacacctatttttaattatcatgagcaagaaataagcttctctgtttttcagccattatacatgtttttgattatagcatttattatagtaagcattttcctaactaccactaccaaaaaaatatatgactagagtctaaatactgccaataaatagtgtcaccaaaacataattttcaactgcatcccaatatgtggtattcatataaaattaggctatggtttatatagcagaagaagaatcagcaactgcaattcaaaggtacgctattacagcttatccactaagaatttaactcttaaatctgaaagcaaaacaacatggttcattttgtaagatataagaaaagcttacgttggtcgtcgtgtctcaagtaaagtcagcaatatctggattgcactgactatggctgactcatttttctccttgtggaaaatatttgatagaagctgctctataatttcttgcctagggaaacaaatcaataatcactaactgcagtatcacttatcaccaacaacctcagaaaaaaagacgacggtacaagacaagcatcactgaagagttcatacttgggcatatttgttttactattttatttctatatacttattaaagtaggcaattgatcctatttataaattacacacatgcacccgcacacaaacacactcactcactcacccttctatctctttccctcagcaaaataacctgggccatgcttgtctttgccaattttgtcgagagccaacagaatctcaagaccaagtcacctcctactcaaaccaagactctgatgatgatgatgactggggctgggggtggcaagaagacatagaacctttcaccctcactaaagaagggaaaacgttcagaaaggctaattagaacccatgaatgttttcctacaaaagcataaatgtgtaattagcaaagatctaaaacagaaaaaagaaaacatcagttgttgcattttactctacaaataaaatttgaaaaagcaaaataaaatggcagcaatgaaataaatgtgactaaattaaatgtccaaaaagcattatctgcaggctctttccattacacttctctcatacatagtaagataacaattaacataaaccagttcattgaatttatatgaacattctcaaggaaaactttagtttcttagcctctcagtaattttcgaaatccatgtgaattaagaaatggacgccaggtgcagtggctcacgcctgtaatccccacactttgggaggccgaggcaggcggatcacaaggtcaggagttcgagaccagcctgaccaacatggtgaaaccccatttctactaaaaaacacaaaaattagccgggcctcgtggtgcacgcctgtcatcccagctaatcagaaggctgaggcaggagaatcgcttgaacccagcaggcagaggttgcggtaagctgagatcgcgccactgcactccagcctgggtgacagaacgagactccacctcaaaaaaagaaaaaagaaaaaaaagaaaaagaaaagaaaaagaaatggaatctcccttacagtgtgacatgcagctgggttgtccttggttgctcacctgacacctcatcccaaggtatagctgtgttcagtgtactgtacaccagttccttgatcacctcttgccaacgtagggcaggaaataggagagaatctctttctattttggggaaacaaaactagtatctaacctaacttgagaaggtccccttgcaagaagaggtttttcaagtactctcagaccagcaataattgcttgtgagatctctcaccgaaagagtactataaaagtcacttaacacacagcagtctatacactaactattaggtctggaaccaagctctggaaaacaaactatcttttaaaataaatatgtttttctttcaacagcagcctcaccccaggtggaggggtactgacagcatgtgactgtggaggtccacactctcttcattcaaccatagcgctcttactcatcagagggcactgtcactttcgtcaatacagatgcctgaagatggctaacagaggccctagccatttcaccgctgtgtcaaattggaagtctactgtatccatgaaagaattctactaatggacaagaaaaacataataaccagcgaaaacttgacagtcaaaatacaataccacaatagctacgccatcttctgagttttacctaaacacgcaagtatcaccaaacccagaagaaataataaaccaaaggactgaagcttatcaaacaaaataaaaggaatgccttcacattctttcaataaaaagatatttaattacatgcgagaaaatatattcattttcacattttaaaaaatagcagtttctggatagacatcactaaaactcatgatatgagctgtttcctgcatgaagccatccaggttctttatccctgcctttgggacaatggctcattgtttttttttttcgttttttttttttttaatgagaaattcacttacaaaaaaccaactggctcaagtgaatgggatcaaacccaacttgttataaggtcattagtatcaagaattcagatacagagtctattctaacataactgtttttaaaaaatttttgaacttcaaaaatttccagtcactaaataaaatgcattcaatttaagcccagattgcttcccaagccaaacattctttatttaacacttcagtccgctttctgagatttcttggtacctgctctttagcatcttctttaaccttagctcatttcaaatttttccatatgtgctatctgtgcttaacatttatgcatgtgatgttcatatatacagtggagtccacactgtgggttacctggcatcataatatagagctcggcaagctatgtgtacattatgtattgccagtacagtgatttaatatgtaatatcatcattattaaataactatgatttatcaaatagatattacatattatcacataatatatcaaatatatacagatgctattatgattaataagtttactaaaatggaagtcttttctcactgtgtattgtctgaatcaacagacactaaaaagatgtgcagtgtgtcaaatattagaagtggttggttcttattctcaaacagactgtgggaagcactatgacagattttctttccactgttaaatgcaatggaggttttacttggcaacagggccattgattcatcaggtccatgtatttgaacacatttactccaactaatttaatgatgtaaattctaggcatttacctatcttcatccagaaattagctacctgatctaggactaaaacacagcttgaaatataaaagctagtgcgcacatgggctctggtggctaggttacacattgggtccaaataaagctgtgtggacggaaggcttggagtggcacgaagaacttagcaatgactactaagcagtctgatattcaggcagaacctgcactgtctactatgggagccattcactacatgtggctatcaagcacccaaaatttaactcgtctgaccggcatgttctaagtgtaaaatacacattggatttccaagactttgggcaaaaacattttaaattacatgtggctttgattctatttccactgggcagcactgtagtgagccatatgaaactgctgatattcaacatttctaacctactgaaatggcaattttacaaggttcaacctaattaatatcacaattagtatttgaatgtggggtgtcttatatgttttaaaggactatatatgccatagtgcaagaattactaaaatgggacaggtaagatgccattttactcagaagccggcaatcttttgtagttttgctacttcagagaactcaaccccttcgtattctacatgctaggaaaacacaattccacttcgcaaagacagggttgaagacacattaacttgtctgtaatgtattccctgcctgtcttacatatgtccaggaaataatacattttattttaataaaacggcattataggtagttaagccaaagatgcaaaacagcctcaatatacagcaggaataaaaaggattgacaaaagcattaaaaacaacaatagaagtaaaccgaagcaagattgccattagtacttaacaatgctagctgtatgcatacttcccaattattctcccatagtgaggagtggcctgattattctctattaaaataacgttcagctgtttgaatgcaggtcaaatatacatgcccatgttgacagtaaacattctttttaaaaacatgtgaatctagaaaaaacagcaccccatccccaagctgtcttcaacctaaacatgagataactgtccctaatcggctgcaaagatacaatgaatccttaaacatcatctgacaaaagctgctgaataaaatgcacaacattcgtacttacacaagactattcttcatcaaaagacccttggaagctgtgactacagttatttctaaatgactaccacatcttaggatggctctacagaattccattttacaaataattggaaaactcaaagtctagatataaatgtcatttatcttcttaccctgccaaacttctactgagataaaagaagcaggtttccctaccttctcacccacccaaggttattttcaaggcacatgattcccacataaggaacacttaccaatcactcacaatggtaacacatggaacagcatcaatatgaaagaagaacaagaacagagttttacacatacttttctagagtggcaagcagggggtcgggctctgtactgttctgaatttgtaacatctggtctctgctcaggcgaacaatttcacaaagtgattgtgatgcatttgaatgtcgctaaaggaaaaaagtacaattttaaccataaaacatgttagaagttaaatttataatttaaaaatgaaagggaaagttatttaagaaataacaaattaacactggccataagcttcagtgcgcaaaaggtcaaggccaagagagatcacatcacaagtattgtattttgtcaggtgaatgagctttataatagtgcacagtacattactgctatgtgcagggagatgtcgtcaaggttctgatgaggaaaaatttctaaaatagttgggaaaaaatacagattgagcatcccaaatcgaaaatgctccaaaatttaaaacatgacactcaaaggaaatactcactggaacatttcagatttctaggtccaggatgcccaaccagtataatgcaaatacaggtattccaaaatctgaaaaaaactgaaatccaaaatacctctggttccaagcatttcagataagggatactcaacgtgtatccccaaaatacactcttatcagcatagaaggatgcacatactttttttgaattaaaaaaaagtgaaagtacagctgggtgcagtggctcacacctgtaatcccagcactttgggagactgaggcaggcagatcacctgaggtcaggagttcgagcccagtgtgaccaacatggagaaaccccatctctactaaaaacacaaaattagccaggcgtggtggcgcatgcctgtaatcccagctactcgggaggctgaggcaggagaatcgcttgaacctgggaggcagaggtggcggtgagccgagatggcaccattgcactccagcctgggcaacaaaagcgaaactccgtctcaaaaaaaaaaaaaaaaagtaaaagcaaatacagttttctggaaaatgccaatggataagaaatattaagccttctctcagtgtattgaccttacagaaaagctctaaaatctcagcacccaaacacattttattctctggattaagaaactgagcataactcaaagactgagcaatgtgctcccaatacaggcagaacactcatattctagaagagaggagagcacagattaggatatccaaacccactgactggaatcaggagcctagcatttccttggtaactatcaactggccagtataattttaacatggaattcatcacttaatacaaaacagaagtgtcaacaggactgtccaaaaaccaaaattaactttcttctaagtcatgcagagaaggtactcatgtccacaatgcagtgtccttctcaaaaaacttgttgcagaattggacttctccattatcaatttctcctgggcccttcagacagcccctactgagcaatcctcttcctagcccattgagcaatcaagttcctctgctcaagaacatgaacctagcaaggagtaagcctcattcatggaaactcctccctgtcaacggggcaggccacactcctgtcatggctctccacggcctgcacaggccacactgtcatcacagggaaacctgctcctagaaccacactcccctgcccacaggaggagggcttatcaccccagctaggttgagagcaccttctaagcaggggctcccacattcccaatccatgtctgcactggatgtgtccacaatgtcaactctgctaacagtaacaactactgcaaaggagcataccttgcattctcccaaagagggataatggggaagtgacagtccctttaataaagtccaggtatgaaaagtttctgaatggatcagagtgaaagggtttcgctctactatcacagaaaatgtatttctgtgagagagaggagcctccattgcatgtctcttcctgcacagctcctctgctgtgctcgctctcccatctaacctgcaacctagagacacacaaggagattctcccagcttcaggacaaactttgaattgcccttaaaccaactcctttgtagatattaggctgaaccatagagaactatcatgtctgtaggtaaaaatggatgactactgccaattttatacggcttggccaagatacttaaggtggtaaccttatagatctcttctagagacacacacacccactggtcccaacaggcattccctcagcacagagttcaatctgcaaactccaaatctagcttcaatcctgtaaccaagtcaacctttagcacctaggactaaggccaaacctgtcagagcttaacagccacggctaggaagtataacaaagttactgtaggggctcaatggtgaccaacatcccacttcactgcctgcaaagctgtaaacagactggataaaacaaatgcaaatgtggccacatcaactgctacagatgggtataaaaataaaaaggaggccgggcacagtggctcacggctgtaatcccagcactttgggaggccgaggctggtggatcacaaggtcaggagttcaagaccagcctgtccaagatggtgaaaccccggtctctactaacaatacaaaaattagccagggtggtggcgggcacctgtaatcccagctactcgggaagctgaggcagagaactgcttgaacctgggaggtggaggttgcagtgagctaagatcgcgccactgcattccagcctaggcgacagagggagactccgtctcaaaggggaaaaaaaaagtaaaaaggagcataaacaaaggaggtttgtacaaaaaccagctggttcagcatgaaataccggctctagaaaggagatggtgctataacaagggcctgctgttgtacacttctggaaattttctgagtattggcaaaatgtaatattgtttagaaaagtatcaactttaagaacactagatcgctgctattctccctgtatgctctgatcatgttcacatttaatataagtatgctctgtgcccaataaacagttttttgttttttttttctaatcaagtttacagtcacacaagtgaacttacatcttcttcttgcgatggatgaactatttccacaagcctctggataattttctcctcatttaaccactgtaaaacacattgtagaagtaatcatagcaatgagtggctcttgttcaagccccaatgtagattaacatacttggaaatatccatcacattttaagtagaatgttacaggtttctctggactttgaacactacagaaaattaaaagtcccccaaggaaaatgccagtgaatatattgttttaacaatggccaacagtaccaacaactccccaaattacaatacccacacactaaaattctatatatcagcttcttagccatgaggtcacctccagacatttaggactaaaagggtttgtaggttagttcttaagaagagagggctgggagattaagaaggatggaatttatacattttctgtaagagcacgttcattccaagcttcagaaagattgagaagagcaatatttagcaccaagtctctgggttaagaaaaacacaggatgaacaaatgggacttttagattacaaaaccaaacccactgcaggaaacgtgggggctggaggaagcacagaggcagagtttttccgccctgtcatgtgctggcaaagagctatggccatctccttttaatccatgtatgaaatgctacagtgaatgaaaacataaaaggaatccgaattcagaaaaaataaaggaaaaatcatctggcttaacattaatgccataagaagcccaaaacaccatcatcaacaaggcagctcactacctagaaaggacaccacccctcctctgctcataaaaagcccggaaagctaaaggagactagggcgggcagcgggggcagaaatcaaacacaatttgcttaaggaacagagaagaaaccctgacactctctggctgctcaacgaaaacaccaaacaaaggaaaatgtgaagctattaggtaggcaccacagaggtagaggcccaacttcatattttaatatctgttttaaaatgtgcacacaaattctccgagaatcttgttcaaatgtatattctgattcagtaggccaaggaagagacctgagattacagatctctaacaagctcacaagtgatgtctaggaccattctttgagtaataatgtcccgaaacagaggagagtaaacatctatgtgaggggcggggcattcctgaccactacaggagaaaccaggaaactttccaggcggcgaactaatcaatcccagactcctgctgtctccacagctattcacaggcacctacattccaagcccacttctgtagtcatctccgactgtggatccacaaaatcaaaagacatttaggggtttctaactaacctttccccaacctacacctttatcaacctcctatcgctctctctctccagaaacacactgattcctttggaaaccagacaggtcctaaacttgaacccagaagcaaccaaaggaataaactggttccagtaaaccatcctgaataaatctctccctatgataattccaatataaaggtgataaccccctccctgtcctcagtcttccccaaaatcctcaacctcttttgggaaaagatacatctacaaagacacacccaaaaggaaacaggtgtcccaatttaaggtccctgccaacagacaagtcccaggacacccactagatacacccagctgtttactcacagtgatcacagtgcctgggtcaccaacaaatccagccctgacaccatcacataaatgcacacctggcacacctccctacctcactggaacatgccctgccctgggcaccacctgaaagaccttcctcctcataggccctcctagtccttgaggtcttaaataacaattagcattctcaacaaaactcatttccaaagaaatgagtaagttctaaggttgcaggttagtattaaagacggatagactgaagcatggttctgcaaagcttctgagaaagggaagaaagggagggggaccgggagcagtggctcacgcctgtaatcccagcactttgggaggcccaggcgggcggatcacctgaggtcaggagttcgagaccagcctggccaacatggtgaaaccctgtctctactaaaaacacaaaaattagccaggtgtggtggcggacacctataatcccagctactcaggagactgagacaagagagttgcttgaacctgggaggcagaggttgcagtgagccgagatcacgccactgcactccagcctgggcgacagagtgagactcccaactcaaaaaagaaaggaagagggaaagacacaaaagacaagaagagaaggcagagatgggagcctgggagaaaccttattttcaagttactcacaccctcccctcttcccacccaaattctacctgagacatctattcaagaggcacacatcctaaaaatcaccatctgtctacattttaaaatatgtccttctcaaagtaaactctgttctccttatcctttgctcctctgtacccatgagaagagaattacttctgaagcctgaatccctggatacatcaacacctctccgttttgaccttcagaggtggccctgaagagcgtggcctcataacatactcaaatgggacttagagctcccaaccctctcatttctgcttttaccatcagaaccagcttcaagacaaatgctcaacccataaagtctcaccacccccataaaaagcaaaccagcaaaaggaaaaaatactcacaacaaaacatcctacatacctagggatgtgcccatctgaaattctagttctgcaaaatctggatctcttcctatcttggaacaacctttcttccccaccctgttacctgctccccagacaaccctctgctaccaaccctaatcccatgcattccttcccagcacacagcagcctggtgggctcacatgccagcaccctaaccccagtcaacagcaggtcagaattctactcacattcagcacatcttgcctgggctgtggaggttcgatacacgtcaggagcctgagcaacaaatccatgatagcagaagttcctatgtgctttataataaggtctacaaaatcatgcttcttctttaagaaatccacaatctagagaagaacagatcagaaactgaaagacatgtaacttggaaactataaactttaccttttaagtcccaaccccgactcctccaaattctaccactactttaggttgagaaatggcaaatgctgaattagcaacaaggtatcaaattggaaagcctggctaatagttacaatactcaaaataccccttggaaaaaaatcccctaaattagcacgtccattaatacaaatacaacttaacagaatcttttatttctattcactttcattattcattctcaaagaatggtgatcaaaaatttaatatgcctataaagagcaagagaatataccattttacagtttatgaacataaagcatgtctgttagattttgcactaaaataagtaatattcaaaatcctaattggactctaacaagcatgagaaaaaaatttcaaaacaaagatttctactctagtcaaaataactaactcacctggctacacaaacatcgcctttgattttgacttcaccaatttactccaatagcttagcacaagaagggcagctggtggagaggcagagagctaccctgaaggaacgtgagaatggccacggaaatcaggcccctgttgctggtctcttctgctctgggagaccagggagatgactctgtcccatgcatccctgtgtcccatacagccttgttgcctctgcctctgtccatgcgcacgtgtcatctattcccaaaccctctgcgagtcccagggggagtgtcgcagctgctatataacaggatctcactgaaatttctcaaaagctctggggcgtggggggttggataactcacccccaccgccacaccccattagagatgaggaaaccaaggctcagaaactatcttccagagctaaaaggtggctgcctgggatttaaaattggatatgtatgccacaaaagccacaatctttccattatgccacatgaagtctaatagccagaaatgacaactaaaactgcttcatacaattaggtataaatacaggattaaccaacacacattgcttctctagacaatgaggtcaagcattatgatataaaacttcaagaaatgatatgacacataaataattcactcacaattggatcccacaagtttttaaaaggacagtagaggagaaaggacgaaaaaagtcacatgtgtcccaagtattccgtaattcagtgccagaaacaccaaacctggagcccaaaggaataaatcccagctagtgtggtggacagtacagcactgtcaacagggacctgtggcacagatgaccccgctggggtgctgactcatgcagcactgaagatgccccaccatccgacttcctgttccatgagctaacaaatgcctttattggttaagccagttgagtctcaatttttgtccttacagttgcatacacccctactaatactatcacataacagaaaacctttatttacactcctaattggcaaaggataaagaaatgccaagtttgatcttaactcacagccactgaatcctcttgctatcattcatacagtcctgacagggaagtgtaacaagcaaaaggccgaggggctcttgtctcagaacataactggcaaggttttaagtgtattctctctctttatgtgtacactgaaaatcggggctcgccaacttggattccaacagcacagaagtgaggagaaaaagcacaatgaagcataatgtctggataatggctacaacaaccatccctgagaactgcctggtaatatcagggtgataggatggcttccactctcctaaaacagccagcagttcttgtatttctaactagaaggcagaaaaaaagagacaatctacattaatcatgatttggggattattaccaaagtgaaaagaatctcatttccaatcaacttagaaagcttatcctactccattaagtgaaagaaagaaatatctctttctaaaataaagcatgtatccactttgccttggcataggacaggacacactgggcccaaaatagctccagtccttccacaagtgctgatagcaacaatgggtcacccagagccattttctatcatgaaggatggcaggaccaactggtttgaccacttttgccccgtatcatcacacctatacttgcaattctggcaaatctgctatagtttatacttgaatatctgaggctctagttgttccctgagtgcctatttccataaaatgactaaaatctccagataagcagatcctttttcacaacaatatccactaaagcggtggttctcaaatgttagcatgcatcagagttagctggaaggcttgctaaaacccagactgctgggcccatctctcagagtttctgattcagcaggtctggaataggactcaagaacttacatttctaacaaattctcaggtaatactgaggggctgctggttcagggaccacacttagagaaccaagtgaagtttctgtcaaaccacactggataggaacagcacagctgcaaatgtacacagcagtctatacactcagatgtctcaagcctgacactggagaagttttgagtagaatcaaaacagaatcaccattagtacaaaccaatcaccaattacatttgtgggaaaggtttttggtttaagcttcatctctgatcatcaatgggggaaaaacaaaacaaagcaattgtttggtgacatattcaactgcttagttattatacttgccatcttagttaagccctgtcttcacaaatgggtacccaatattctcatcttctacccacttctcaaaagaggaaactaaagtatgctaacaaattaagtgaaatttgagattatgccatattagaaatattcattaacatacaaatagtacgtgagtgcttagaatgtttaaggtttaaaatacattctcttatacaacctgaacttaaggcaaagttagaactcttaaagcaacaagtactgggggatcacctcaaggggatgatcagccctaatacttaccttttggaaaatcatatttacctgttctggttttctgctgataagaatacttagcaccttgctgaagaaactggcaagtagtggattcaaaggggaatcgtttaggaggaagctatataatttcattagcaaggattcatcttctcccagtctatcattcatctgggagacatcagaagtgagcaactcacaagatatatttggatacctagaagaacaggatatttacatcatcatctttattaacagtttaattacataaagataaacacaaatcagaaaggcttcccaagattttgtgaaaaaaataaaatcgtttactggaaatcaggaaatcatttcaatccattctgttcaacctacctccagactaaaataaattttctactatctaaaaaattgtttttaaaccaagctttaacaagaatacattttccctgaagaaactagagcgcacctagtactcagaagcccagagaggtcatgctgcagggcccgggccttctccacgatcagcgaggaaagcggctggacgtacgagccatcaggctacagcctcctctggcatgggaagcagcaaagcttgcggacaactgtggaggacactggtttccaggaaactgcactgcatgcagcaccttgtaatgacttaaggcactctgtagggacctggaccagcctttatctttagatgggttgtaaatggtactaagtctatattacatcttaagagagtaagcatcctactataatgaaggggggaacaggacatcagcctgggctaccaaggcaggaagcagtatacaaaaaaaatgttgtcctagctatttaggaggctgagattagaggatcacttgagcccacaagtttgaggctacaaagagctatgactgttgcactccagcctgggcaagagtgagaccttgtgtcaaaaccaaaacaaaacaaaactagtgctctccacatcagccttccagtatctggatatcagcacagacacaaagtcagcccaccatgagtcttcaccatgctgtctctcctgtagaaggcccacggctaagaacatgacacctgctctatatggacccacacaggctcttctacagaccccatggctttagaaatgcttgcctctgacaaccagaccactgaccctctgcaaacaggcagcaggtccatttcctccacttactcctactatgacaatctcgtgtctgttttcactagcaacaacagagacgttgagcctatccagacgatactctagctgacccagaattactctgctcttacactcctccctgctggacagccaggacccagcgccccaacaagtcatcaggagtggcaagctcaaaagctgagcaagacagagagatggcaaaatagccaaacgtggctgcatgacaaaagaaaccagggaagactggggcaggagggacacgtatacgacacacctggggcatccaaggcaagcaagtgctgcctgcagcaagaccctggcacaaaaagaccactggtgacgaaccagaaagccacggcacttgacaggctctggtgtgaggcctaaagacagaagagtatgagaaggtcccaaaatgagtctttgtataaagaaaacagaaaaggaaaaaaaaaaaaaacagacctggcagatgtatgggtctttgggaagtaaagtctcctccctcaatttacgtagcatgggcttcaagatgccagaatataaacccctgtaaagtacccattatcccaggagtgggctgatgcagcggttacaggtgcagctactagagtcacactagctaagttcaaaaccggcctctaccacttacatgctgtataaccttggacaagttacttaacctctctgggcctcagtttccaagttagtaagattaagacaatagtccttatcttatggaggaggggagtaaaaaaggctgggaagagggcctggcataaagtaaataagtgtttaataaatgacagctgttttcattcctctttattttcactataaaatggcagaatgctgctagagtgggttggggagatgcactcactcaactgtcttaatgtggaaactgctgacaaacagaagatcagtaaaaggcaagcggactcctggctgtgaatcaaatgcatgagtgttttctccaaactctgacagagaaagtccagatgagcaactttaaaatttgttcactttttctaggtgactgggtggtatgacctaactcaagaagcatgcataatgttagccattacacaaaaagctcagagttctggttccagacaggctggggctactctccttccctccctccttaacattcaagaagcttctcaaggccgagcgcggtggcgcacaccaatagtcccagcactttgggaggccaagatggatggatcaccagaggtcaggagttcatgaccagcctggccaatgtggcaaaaccccatctctactaaaaacacaaaaattagccaggtgtggtggcacacacctgtagtctcagctattcaggaggctgaggcacaggaatcacttgaacctgggaggcagaggttgcagccagctgtgactgcgccactgcactccagcctggatgacagagcaagactctgtcttaaaaaaaaaaaaaaaaaaaaaaaaaaaaaaaaaacagcagcttctcaagcacccaaagatgcctccactccaccctcggcaagacccctcctcctccataggctctgacctcgcttcctttgcctgagaacacagagaaggcaatcagaagggaacccagccctatcacatccccacctacagctgggcacttcctcctcgctccaggggaatggcccttgctcctgaggtcatctcctgcatgtatgctctggaccacatgcccccacccccgcccactccagcacaatgcatcactcggcggcctgctccctcacactggctgtgtttcctctgtgctgcaacgttctcacaggtcatcacttccatttaggaaaaaacaaaaccccacaccacccctgactccaaatctgcctcgacctaccacttcctctctgctcctgttacaagaaatcacttcaaagagttgtctctgcttgcctccaggctttcacctgggcccctccaaagaacctgtactgatggggcccatgatctccatgttacaaactgagtggtttcttatgagcagtaccgctaacccactgtcccccctccttcctgaagccagacttcccttggtttccagggtagcagcccccaggttctcctcttgcatccaatcactcctccatccctcagtggaacccaggccagcccacactacccatctccagtttcagaagctttcttctagctccatcagctctgcaggcgatctcattcagccttgtggctttacatgtcctctgtccacctaccactaggcctcatctccacctcatgtctaacaggcatttcaaatgtgacagggccagacccaaactcctgccctttccctctgcaatcttatttcactgccataaagccactccccatcctcttaactgcccaggccaaaatcctcatagtcactcttgacactttatctcccattccatacctagaggaaaccccttcagttctaacttcatctagtgcctctggaaatctgaccgcttctcaacaatcaggtccactaagatcttgtttttctctgctgatcactgcagccaactgtacttccacttctgtcctcctacagtccctaaccacagagcaggcagagcactcctaaggaacaaagtcagactatggcacaggttgcaggaagtcagggaccccaaacagagggaccagctgaagccatggcagaagaacgtagattgtgaagatttcatagacatttattagttccccaaattaatacttttgtgatttcttatgtctgtctttactgcaatctctaaatataaattgtaaagatttcatggacacttatcacctccccaaatcaatacccttgtgctttcctatgcctgtctttactttaatctcttaatcctgtcagttgaggaggatgtatgtcacttcaggaccatgtgataattgccttaactgcacaaattgtacagcatgtgtgtttgagcaatatgaaatctgagcatcttaaaaaaagaacaggatagcagcgatgttcagggaacaagacagataaccttaaactctgaccgcaggtgagccaggcggaacagagccatatttctcttctttcaaaagcaaatgggagaaatatcgctcaattctttttctcagcatggaacatccctgagaaagagaatgcgcacctgggggtaggtctctaaactggcccccctgggtgtggtcatctcttatggtcagtgcagaggtgagacagactccagtctcccataatgctcccaggcttattaggaagaggaacttcccgcctaacaaattttggtcagacgggttgatctcaaaaccctgtctcctgataagatgttatcaatgacaatggtgcccaaaacttcattagcaattttaattttgccccggtcctgtgatctcgccctgcctccacttgccttgtgatattctattaccctgttaagtacttgatgtctgtcacccacacctatttgcacactccctccccttttgaaaacttctaataaaaacttgctggtttttgtggcttgtggggcatcacggaacctactgacatgtgatgtctcccccggacgcccagcttttaaaatctctcttctgaactctgtccctttatttctcaagccgactgacgcttagggaaaacagaaaagaacctatgtgaatatcggggcagattccccaacatgcacacatttgctcaaaaccctctggtggcttcccatctcatcccaagtatagcaagcatcctggctgagcctaccaggccttgcatggcctgtctccagaggtgctccaccttcactccaaccctccctccttccattttccctcattcacaatgctgccccttctctggctgcccagatgttcttggggcacaccaagcacatgagcacattagtgcttccacacttgctgttccccctgcctggatgttcctggttgtaagtgcccacctggcaacccccttaattcctgcatggctctgaccagatggcaccatcttaattaggcctttcctgagctcctctgcccaccccaccaccttcagcagtccctgtctcgtcatgcttcatttttctccagaggtcttatctgaaaaattattgggggactttttagtctggtttaccccaatacagcaattactccatcatcccaaaactacacaatcccagtctaaacttccttaaatgactgtagtcaaccataaccctaaagcactttcagatcccagctgaaaaacccctctatgctaatctagctgtggcatcatccaagatatgttacacacaggtggtgactctgctcagggcagaagcatggcagagtactgccctatccaactcaagtggtgctccttcaaaatggtaccatgcagaaggctgtgtccagaggaggtgcatttgctcttgcaacctcaaaggcaaaaacactgacgaagcaatataatacaagtgccacactgttataacggcggggggtgcgcagtacttttgtggaaagtaagcccttcatagaaggcatgcctactcttcaatgattaaaacattactagcctcattcagcatatgaggaaacagacccaagaagggtaagctccctgcccaagctctcagagattggaagagaagagggtcatactcttctgaggaggctgatccaaaatctgtgctctctgatgcataccacactcctccatcagggataagccccaattcaagtagcaccacccacatgctagttcactgtgaagggaattccaagtagcaaagtgtctatcatttgggggatgacagcacactagtaggtctgtcacggcctcccgggctcaagtgattctcctgcctcagcctcccgagtagctgggattacaggtgcctgccaccaggcacagctaatttttgtatttttagtagactcggggtttcaccatgttggccaggttggtctcgaactactgacctcaggtgatccacctgcctcagcttcccacagtgctgggattacaggcatgagccaccgcgcccagcctttcctcctcttttattaagacactaatctctgagtgaaggctttcactaaatgcaaagtgtcaatgttaatggttggcagagaacatgacatctctgaagacctaagccactagcaacttgaaagcattaacaagtattatttccctaacagcacatttctccccaagacgaaaggaaaagatgtctgaaaagaaaggtaaactgagggacaaatggcaagagagacactactaaaagcctaattcttcctgttccattaagtttatgtaatgcatcaatttttgtttctgaagttgctctattttctggggggaaaagagccaaatatttcaatagagttggatatggagaaataattaactgaaaccccaatactttacatacctatggagagtttccaggggtttgtagaaaaagtgttacagtgatggtaataaaggattcttactgtactgtcgttctctttgtaagcagattaaactagcagacaaaatccactgtagttacccatggtacccattcctttactttcagtgaatgaaaggtcagaatgtattgtataagcaatgctcttcacaaccccaagctctgacttagatctgctgtgcgattctgcatagtcacatcatgtccatcttcctatttgcaaagtaaatattttaatcatcttactattttgagatatttatcatcattgtttacaaagcacgctgcctttccagaaaacctttgaatgaaattcagaacgctcatttttaaactcttgtgattccctggacttaactgctagaatggattttgcgctccaccgagcctgtcattcttgactatcttacccttctgtaaatggcaacagtcacactggagaatccttgaacaagagctgtatattctacccccacttcactttagtcccactctacagagaagattgaattgtcttacttgtatctgatcttttcatccatgtcttgaggtggttcttctataatgaatgagactaaatcttcgagacattctgcttttaacagaaactctataagtttgcggttctgagctttacattcctgtaaaacatcttcctcatccattaactccttcagtgttacatcttctctttctagaagtgtgtctatgtgggatgatgagtgaagatcaaatttccaaaacatgctggtctaaacaaaatgcagaaagtatttcataaaatttcaactttacaaattaattttccataattcatatttcagttcagttttacaatctaaaatgccaacttggctcacataagttaaataagcttcacactgaacctataaaatactttttaatgcgttactggcaggattttttccttctcagaaaagaaaatattttaatagataaaaaattttgacttgaaaatgctcaaagctaaaacttgggatgattttaacctgcaaaagtaattcatccatactattaagaagtgatgctgggaaaggagaaaagtcacccttttcttaagggtgaagaacagaatatcttcagcaacaagtgataagcagtgaggcctaaatatctagaaggcttcagaagactaaagaactaaatgatcactgcaaaccagtactttcatagtcaaaagcctgaagcaataaactggtaaaatctgtgccattcttaatatactactaaaaactgaaaactaattcttgaggagttagagaaactgattctcctctgtttactaggaaaacatgacaatgaaacctaatcactacgccacatacatattcattcctcagcttcatgcccatccttcctcaacaaggaaaacagagtttgttacttcaaattatagagctaaaaaaagtacttatttgttacaaatggaaatataaaacagagggttcactacatgatctacaggctgccattcatgatgggatgatctcaaatgccacttttgagacacatgacaggatgatagcatcacaggaaaagacctcagtagagaccattcaaagacctttcctatctgtctaaatgctcactgcagaattcctaaaccagagtttgttaatacatactgactctctgtaacccccaaacgaaaacctacatataagctggagcttcactacccacttagtgaggtgtaccattatcattatctccaaaaaagcatgaatatccacatgctatttaaaagagcctaggtaaaaggaaggaggctgcaaaggatggtaatccatgtatagcacacatttttagaagtatgtatttgggccgggcacacagtggctcacacctgtaatcctggcactttggcaggcacaaggtgggagcatcacttgaggtcaggagttcaagaacggcctacacaacatagtgagacctcatctctataagacaaaaaaaaattcaaaaaattagccaggcattgtggcacactcctgtagtaccagctactaaggaggctgaggctgttgtaagccatgattgttctcctacactccagcagggcaacagggtgaggaccctgtttccacaaaaaaacaaaaaacaaagaaaaaaacaaaacaaaaaaaacccacccactttaggagatcagacaggaatacatcctgattttatgcttttatgaacatctgcctcaaaaaaaaaatgttttttaaatagagatcatagagagcaaaatcatttacactgctagtataaacactgatcaatccaggaataacagaaggaaaacaaactctgtaccatggttactcaaggctctgtaaaaagtagatccacttcacaggataggcagtgagatcactgaacattttatatgagcatataatttaaaatataggcagagttttttgtttgttttttgcgagacagagtcttgctctgtcacccaggctggagtgcagtggcatgatctcagctcactgcaacctctgcctcccaggttcaagtaatccctacctcagcctcccaagtagctaggattacaccatgccatcacacccggctgatttttttttttttttttttttttagtagagacggggtttcacaatgttggccaagctggtctaaactcctaacctcaagtgatccacctgcctcagcctccccaagtgctggcattacaggcatgagttaccgtgcccggccaagcagagttttaaagaagcttccaaaagctccttaaggagcaagttttaaataggaatattataaaatgtgaagggtgttataaaagtcttccttgtttctaaaaaaaactttaaatgctttaaaggacacatggcgacaagctcacatcaattagcagcaacaggaccaagacatatttaaggatggcagccactgtgatgatccacctggacacaacatcttacaagaggagtcgatgtggaggactgatgttcagcacaaagctctgtgggatgacacaaagcgggggcccacagtcgcaggcagggctgtcttgttcctctattcgattagtctaataattatgtccagatgacatcacagaccatgctagagaagcacaactcctcgcactgacagcagccactatgctgctaggctaacaggacttctctgctccagacgaggggtgggtaggggcatccgccagaagccacccagtgggcaatgtaacacatttgccgtgaaggaaacaagagcaagctaattctaatacaaatattaaagaaataagggcaaagatgaaatacaagtaacaggaaaataactttggggaaaaggtcagtggatataaatcttagaaataaatgctttctgtgattttcagatgagtgggaaatggcaaacaaagtaactttattatgccatttgatactaatacaactaacaagttcaagaaaagacaaaagtataccaaaagataacttcaatggaagagggaaaaagttgggtttccattcattccccagaggaagagaagtggttcgctgtctgagggcacagaataacaatgccagtgccacccaccatgcttctggtggaataatacagctcatgcacctctacgttcttaaaaatcacaaaacctttttttaaaatatatttttactactcttccccacacttagtattaaaggcaaagtatgaaaaatactaagaaataaatcagaaaaaaagtgaatctggcatcaagcacttatttttagctaataataaacagggtatatgttcaccaatcaggtgagaagctatgcctaaaacctagataaaatgacacttctgaattatgaatcaagatacaacttttttgcctcaagtaaaaactgacttcccaaatctcaaccttattataaaggaaactcattaaacactggatttctaaagaagagtggtaattagttgtgatgaaataagaaggtgttggcaaaccaaatccagctcacagcctgccagttatgaatgattttgacattttttaagggttgttttaagaaaaaaaaaggaatatatgacagaggccatctgcggcccacaaagcctaaaatatttactacttggtcttttgcagaaaagtgtagtgtcctttgttccacaggaaataaaagtcccattaacacccactttgctttctgcagtctcctgaatccacccaacgtctaccccacagcccttgcgccctgcccagtgaggtgctgacagtcacccgtctctactctccccttcctggggcactcaccgtgtaggtgtggccacatgacagagtttcctccattgtgccaggaaccatcaaacctcccatggtccttcacctgtatctagctaaatgctgaggaccaaaagaacctgagggatggcagaaccaaaacatggaacgtgccgtggtccccaaatcactatatggaagaaagccacctactgctgtaagttcctgcccatgctgttccagtgagccagaagcaacattcctgtagcagagcccgtgtgctccagcagcgtggcctaactgatgaatgaggtcctccaattccccagccatcactttgtgggtttactacgctgattttaaacttgagatttaaacacaagaaaaggaattctttagcaattatctgttgtaaagtgattaattccttttttttttttttttttttttttgagacaaggtcttgctctgtcacccaggctggtgtgcagtggcatgaccctggctcactacaacctctgcctccaggactcaggtgatcctcccacctcagcctccagagtagctgaaactacagacccgtgccaccacacctggctaatttttttgtacttctgtagagacaggttctcactatgttgctcaggatggtctcaaactcaagcaatcgaccacctctgcctctcaaagtgctgggattacaggtttgagccaccacactcagccagctaattccttttgctccccactattcggagttagaatagcatttttcaaataagaacaccttgaaatacattttaatggtgagttttctttgtattggacatactacaaactcaaaaccaaaatatatccacagctaattccttacacaaaaattatgtattttaccttttagccaaacagcaagctgactggaaacaaatggcactggtaaattagtcacccctgctgggccttcgcttctatgtgtactctttcaagtagaaagaaaccaggtatgaaataacagttacaaagttcaactggccagagccctgaggtaaaatggagtcctttaaaaaatataactactctaaactacacagaaaaaccaaaaagtcagaacttcaacaacttgtttttagtaaacataactatcctttaaaattcacaacctagactacacagtcacacaacaaataatgacagggatacagactgagaaatccttcgtcaggtgacttcgtcgttgtgcaaacatcatagagtgacttacacaaacctatacagtctagcctactacacacctaggctatctggtatagcctattgctgctaggctacaaacctgcacagcatgttactgtgtactgaaatacagacgcagtagtgacaatgctaagtacttgtgtatctgaacagacactaccatgttaagatgttgtttagctgaagtagcaaaatcaccttaaagaatccccccaaactaatcattcatatcagtcattaggtaacaggaattttcattcgtatcagtcattaggtgacgggaatttttcagccccattataatcttatgggagcactgtaatatatgcagcatatgactgttcttaaaattagggataatttcttccaacaaaccagtcagtggagcaaagggtttagtaaagccaaactaccctctaatctttcttcaaaatcctagagttttttgtaagttggattaagtagtttgaaaatggagtttcctccaaaagggctaagattaagaaagcaggtcactggggagtcatttgttacttgatgtcacagatgacaatgtctgctgttccccaccttcctgtaacgtaagacaagtgaaaactgccatcttatatacacaaaataggatcaaaggatccatttgttgagtaaatctattcatcgaagatcaactgctttacttaatgaccctctaaaattattttaaaaccttcatgatatcaaagcctttcaaaatctgaggccaagtaccttgaattcaaggcattcaagcagtgacactctctggaaaaaggtgccaccctgtctctgacacaggaactaggaactggtaaagtggctaaattatttataagaggtagaacaagaacatcagtctatctgtaaaatttgccaaggcactgctagtcgaatgctagcatattcaataggggtccaactataatttatgtgaaccacctacaaccctttgttttcatcaaatatacaaatcctctcaacctcttctaggactactaagaatcttacagacctggattctaacaccagctccactattggctagccctgaggcctcaggaaagctacttcatctctaagcctcaggatccttagcaaaacaggttgtagagagtcaataagaaagatccgcaatagcagctagaacatacaggcaccaacatacacacactcaggcaaacagaagctgctaaggcaatgaatatatccaacaatgaaatcagtgagctttaaagcttcccaaactttcaaaggcacaggaatgaatagtctagggccttgtcaaaatgcagtcttggctgggcatggtggctcacgtctgtaatcccagcattttggaaggccaaaatgggcagatcgcttgagcccaggagtttgagaccagcctgggcaacaggtggcacacacctgtagtcccagctactcgggaggctgaggtgggagaatcacctgagcctgggaggttgaggctgtagtgagctatgatcataccactgcaaaccggcctgaacaagagtgagaccctgtcctaaaatttaaataaataaataaataaataaataaataaataaataaataaataaaacacagtctcagattctgactcaataaacagggctcaggcctgagattctgcatctctagttcccagatgctgctgatgcctgattttaaaccactgctgacagcttgtaattcataaatggaggatcattttaatctacatcttcacaaatttaaatacatatattcaaaataactatacagccatgaaaaacataggaaaagcatactagtgcaaacagtactgtgttatttcagaaactacctctgaaaaagttgatatcagtgggttttcattcaacaagacagaggcagaacataccataccataaacatgacaaaagataaactattagaaccctgaagaaagaaactactggtgatcctacccacaaacaagcagtcaactgtggggatgacaagatcgtcaatgaatttcaaattcaaaatctcctattcatatgaactcactatgcttaaatttggcaactttatatctaagtacaataaactgtatactatcaactgcgaaataactgtacccaggactagctgggcccagagcaaaatgttcagagatttcaaagaagattcaaagattatgatggctttcaagacagaacccaaacaggagagcattaatccaagtgtttctgagcatgcgagactgcacaggtcacacacccatcaaaccagctctgtctataccttttaataactggccccattggaatcctcaagatagcaacaccgaagtgaatatctgatatcatatgccagactggcaataaacacacataagatatttctagtagaagttgccgctacctaaacatacggagcacaaacagaacaaaataggagaagcagctgcttccacccaagaaaacacacaagaaagacttaagacaacaaaatgtgttattgacttttaatactatatatttaacagaacactacaaagaaaatatttgacacacaaatttcacacaatcttatacaaagacatgcaagcacacgctgcccaagttctaattcctatacaccccaagtctcccttcagcactcccttctctcaccactattaaaactactagaactacacaagctctatctgtcatccaagtcagacccgtctaacagaaataagaaataaacttttgagccacacattaaatgttctagtagccacatcaaaaaagtaaaaaacaactaatgacattaaatttaaaagtatctaacagaatatatccaacagggctatattatttcttttggtactaagtcttccaaatctgatgtgtattttatgctcacagtacctctcaatttcaaccagctacatttcagatgttcaagagttacacatggccagtggttgctgtactagacagccccactctaatgacattatgattcagtctctctccgcactgaaatggcccccatctccttccacagctacaatcactaacgatgttttccacacaagggccaatgtggggtaggtaagaagaggttataggccatgtttttcctcttttttaaaatagaaatatacaggagatatcatgtatattcttgaaatgtaacaacttgggcagatattcttcaactcaaaaaagtagatcacaagaaaacgagaactgttttgtagcctctaatacctagaaacatttatagcaataacaagaaagttttcaaatccttccatcttgaaataatgcaaagagctagatcttgcatcaagaggcacaggtgggtcatcactggtttagacttaaggagccaaatttaaaaacagatgcatgccggctgggcgcggtggctcacacctgtaatcccagcactttgggcagctgaggtgggtggatcatgaggtcaggagttcaagaccagcctggccaagatggtgaaactccatctctactaaaaatacaaaaattagccgggcacaatggcagtcgcctgtaatcccagctacttgggaggttgaggcaggagaatcacttgaacccggttggcagaggttgcagtgagccgagattgtgccactgcactccagcctgggagacagagtgagactccatctggaaaaacacacacacacacacccaaaaacaggtacatatctctgagaattgatttcattttataagctaattcaaaatatattttcagaagaaggaacaatgcctaggccactcgaaaatgttgggaaacaaagatacttgattaatgtggacaaaaaactagaattctcactcaacctctagaaaacagacctcacagcatcccttgattattccataagcggcagacgtgtttacaccgaacctctggccgagtttataagcaggctggggaacaggatgtactcaaccaccaagctgaggcaaggctgttcatactggctcatctactgatgcagtgtccagacacctggaggctgaggacttccttctaggcttggattcacccatgcaggaagcttagttgaacagtgcctgacaagacccaaatgtgaaactatgggctccaggagggtctggtgactgcttccaggcatgctgaaagctgcatgccactaagaaggggccagggaggaaagtgtctattaacaggaaaaagcagagtcactcccacggaagttatctcttagtgttgtaagttaatgagaaactcttccccctgacagcaaagctcaatgcccagggaaattttcacaagaaggggcagaaacatggaacacaaaggagtaaaagcagctggtctttaaaagcagctctcaataacttctaaggaaaaagaccacaaaacacagaaagttcacgcagtagctgtttctccattcttagtgaagtgtcaatttcataaaggtgcagccccccccccccacacacacaaattaaatcaaatatcaggtgcctactagagtcaatatatttctttagagaagagggtaatacaaactcaaacccagttttatcgtatctctgcaactgcttcttccaaagaaggtgtcaaaagcaatcagctttctaccacccaggtattccagaatcttttccagtttcaacttgaaactgctttgatatttcaagcatttctttgagaataaaggaatcaaatccatttaatatgctatattaatcaacaggtattaaagtattaatatgaattatgctaaggaatacaggagtaatatgacagatggtccctaaagccttgaaaaatacaataaaattgagaacagagaaaacagagacaggcaggcatacatttcaaccttgttccacagaaaggtagctcaagggaggacaacctggccaaaaatgcctcattatatatcaagcctaagttgagcctcaaaatacagggagcatttaggaggtgatgaatggagctgcataacatattccaggccaggcgacgcctccctgaaagcagtggacaggaagacccagtagcttcaggagtcacagcagtgagaaggccctgaggacaacaggaaggaggagcctttgggtaggtggtaggattaggttggcaacacaaggccagaccacaaagggctgtgtgtgaatgcacggcactgtgcaggcttgctgcagaagcagacagatccagtgagttttaactgaggaaagtatgcattaaaatatctacagcagagattcaacaaagtattttaataacatagagaaacaattctgaacaaaagcagacattggaagtgacgtggagatgacactgatgctgtggttagtacactctcaacagagttcgtatttcctacaaaggtgaaggacagagggaagaggacaaacctcttttgggtctggccaggtgtgaatatgacttaaatatgggacaggaaagaaggggatgaaggtaagacgcctgaggtggggcactgtagagactggtcacggtgctaagacagacactggagtctgcaagagcagatctggagtgtgaatgcgttaactgtcaacaatgtgaaagacagattggagaggggtgagcctaatgaagaggggcccaccggagcagaaaatgatgccttgcaatggcctctacgttcaaagccaaggtatccgctacaagatttcacactaaatgaccattacttctccaatgtcaccagcattctgcctcctccaagtctaatttccactttttcttcattctggagctgtactttggtgtcaaatgatacaaatttatacttgcctttagaattctaagctgtctgggaaatacacaaccctcagaaggcaaatgtctatatatacaccctgtactaactccaaatacactgctaagatgctaacagcaagacaagatgtacaaccttatcattcacttcacttttttaaagtcaaccaccaaccaaaaaatccagccttacttttgtcaactagttcaaattaaagcaactacagtaacgtgttcctctacaaattctcattatgaaaccttgaatgtacaggaatttctgtgcctattttccacaatttcaaaaacttcagtccaagtatatgcaaagcatgggttatttctactacgaacaagtttcattgaagtgagactgaggggttgtgtggggaaaggcaagtaataaggatggcacaatggtagtcgagtttttgccagttgtcttcttaagagatgaaggaaaccgaggagaggcaaggaacacccagctggttccagatgcacgtgtgcatgctggaggtgagggtgtgtgaatagaggtaagatggtatgataaaagccaacgttagccaggcccagtggctcacatctgtaatctcagcactttggaggggacagtggtaggtggatcactttagtccaggagttcaagatcagcctaggcaacaaagggagatcttgtctccaccacagaaagtacaaaaaatcagtcgggcatggtggtgcacacctgtagtcctagctactcaggaggctgaggtgggaggatcacttgagcctgggaagcagagatcacgccactgcactccagcctggctgacagagtaagaccctgtctcaaaatttaaaaaaaaaaaaatgtaagtcaaagtaaaatcagtaaattctcataggccctagaaaggtttcccatctgaagcatccaagattcttggaatttctgaaactgggcaggattccaagagcgaacaaatgagtcaaacatcagaaaggaagcaacaggtaactggaggagagtaggaaacatggttatgactggcatggctatttgcaacaacacaaaaagtttctaagtctccaaaactgaagagatacgaggtggtcctcagcaaatgaaaaatggtgaaactgcttggctagaaagggaattctatactaacgtggtgaaggcaaagcttggaaaatccaagtcagtgtggtttgtattaagtgaaacccagttatgtgccatttataactcacccaacttgaggtaagtgacaatggtcatttattattcaaatatcttacagacaaggtacccaaagaaaatggcctttcctaatcaagtagaaattcaggagcacactgagatgcttttggcaaatggtcaaaaagaagcagtcttcagattaagagctatcaaattctataatgaaagacagattggcaacttagtcacaaaaaaatctttcaaaagcccgtttttttaaagttttagctattatcgtcaatcttccttccctagcaaactttgatcagactgtatataaccctgaagtattcagggctatctcaacagcttcaggctagcagcaataaactgttaaccttcaggaagttctttcttttgtaaatgttttacagtatgcaacctaacgtgcaagaaaaattaaagtagattcatagactactgagactgctcaggaataaaagctcaacagagaatggtctttatagctccttatgaaaaacaatcttcaatctctcctagctattccacaatcacattaactgtctggacactgcaactttatataaaggtggaaacataatttttaacagcagctaccaattattaggtgcctaccatactgccagactctgggcttcatgcttttagatacaagatacttcataccttcaaggttttgttctcattttgcagatggaaaaaaactaaaattctgagagttcaaatgacttactactgaagaccagagctagtaaacatgctagcagaaatgggacacaaacccaggtctgactagctccaaagtgtgcacttttcctagtcaaagaagcagtcatcaagagcatgaccccagcccagccagctgtgtgtggcctcagcttgtagaaggcagcaacggcaggtcagccttgcaatccaatggctctcaggacaagttcaggaagaggaaccatgtgcctctgtgcacagggtggagaatcacttcccagacaagacaactgggcattcagcctgaagagctctggacaagctcagctcttgtggccaggggctctgatggcatggattcacaggatgccacaggcttgtcaaaatgcacagaaaacacaaagctaagaggaagagctaataatgggtaagtcagcagtcacactgtttgacacaacgaaacaagaaaaatttatttaacatgaatgaatataaagtccttttcagacaaaaactgaaaaacaagataggaagaatgccagggagaagaaaactgctgaagtgaagaaaagaaacaaaaaagtccaaagatttcagttcattataagtccaatagaaagttctaatattacgatgtaactaataagcaaagaaatcccagaatatagtaacagataaataatgtctaggaccagaggagaaattaatcccactgtggcctgccctgagcacatcacgtcacaccaggaaatagcatatcctgttctgaaggaaaacaaagagtctggcaaccacatggcatccaaagagatggccaggacagcagaaaggctcactacctggagggataaagtaactacctttgaatatatttaaaagcttagaagagaagacctgtcttgtactgtacccaaggatgaaataagaaccagtaagtaaaaagtgtaaattatctacaagcagtagaagcaaaacttgctaaagatgaggtctgtggcttcatgagaggcccctcaattggaggcgccctggcaaagcctgaatgattttctataggaacagaaggagttcctgttctggacaggaaggttgtactaaatgattaacatgctgttttataaatctcaaaatccattggatataaaaggtacaatacatggctacatttgggctgacatggagctccagtaagaaaatagaaaagattatgtaaccttccagatgcttagtgggttgaaccccacgcattctccactgctctggaaactctagtaacacaacaaaataaaggacaaaggagaaaaaaggaaactacagccaagaacgccaacaattcatgaaaagacaaaaaacttaaacgatttaggaagtccaatattcaaataaaagaagttttagaataacatattataatctatcacccacctcttggccaagagaaaaaaaaaaggggggggggggcaggggggcatgggtaggaaatagaagaaagcaattctcccagagcttaacaaatgtggctctccttagggcctgcacaggccatcacaatgagtggtgcgacagatccccccaaggtactgagtgtagttccatggtagcagagatgaagtatctaaaccttctagtggtgggtggggaggagggggactcacaaaaacaacacaaaaaaaggaccataacttaggatcaattcttgaaaccaacgttttcagacatggaaggtctgacggatctattcacacattttcaggcagctactgcagaatgttcttcaccaaaacatgacaatacataaaaccagaaatacgagacatcaagagatagacgactcccagaagaaaggtgaggagaaacaccagcagttacggagaaggtcaagtgcaaccagtacagaggaaggcatgaggcagagggtttggaaaaagtgagtccaagaaagagacacagctgactgccagatgtatctgaccacactgaagagaattttgcaaattttgttagggattccgggaataattaaccaaaatatacatacctttaatactgactttatccaaaaggtgaaggagggaaggagctatccatgtaagaactaaaacctcctcttcataattagaagccaagtagattacaaacagctacatataggcaaattatttagaaatgtggaaataagggaaaacagctatgtgatgaaggtagcagtcccaagtgagtaattcagagataagaaagatggaacaattgttattttttgctataaaccttgtgatatacctctgactttttagcctccatgaacagtcttcatgaaagaactacaggcagaatattttcaaagaagttgagaaaagacaacctacagtagaatctgataggatatgctacaactgattccggtggtgtatagaacagaaaagggcttagttcaacaaacttagaaaacctataaaaatgtaaggtgtttaaagcttacagttattctttgattattcgccagcaggcatctggagacttttgaaatccatcacctgttactgaaccagtagcaccaacagtaaacttcatgcactcatggacttaaccatcccggtttgccctatcccacagcagcttgatgtggtgaagttttattgtgatcttctgagcacagggcaaagaacgaaatttttctgaacaagaagaacagttgtaaacgaccattactgaacactggatagctgtagaaatctgcctttgctgaagtctcaatggctgacatgtgaatcatctactacattaatgtcatttaaacaactttctctggttgataaggaaggtcaagctgcttcatacacttcctgtaggagatgagctctccattctcatacagattggcagtggacatgttttctgagctgaaactacagttacatagcattttgcagatcttgatgcaaaggcaaaggcaatctccatatttcaaaatccattcagttgtgcaagtaaggagctatcgcctaaactataattagaaatgattaatttactatgtaatgacatgctaaaaagcaagtatcaagagaagaatccaagagaattctacatatgccttccaaataatgaatatactcaactgaagtaatatgcttggggactgatagagaatgtgggagtacctacctgtgtaaaaagacatttccaaagatgaaaaatgtaaaaccttgctgcagatcaatattaatagattacatgtacctttgcaatagattttgatgggagcaactctgactttaaagaccaattaggtgaaatattatccccctagaataaagaattccagtcttctcactagtaagagagagctgtattacagaaaattgaactaaattattacattatgaatctcaccaataacaaagcctgtaaaaaattgttgtgtctcttggtatataaataccttcataaaatcctcttttttgcctcttggcccgcaaaacctaaaatatttattaactggcctttgcaataaatgctttgtttgccagcccctggtctaaagtgccctatacctacagtgctgttcctctccaggaaccctcctaaccacctggcattgattctaggactcctggagactttgaagggttcactctagtgtaggacagcatgctgacgagcagagatgtgtaaaaggaggaggaggaggaataactaaaggtaagaaattgttccacaagctgccaaagctaagaatctctatcagcaaagaaaaacaaaataaacaaggagagagaaggaaagtctcaaatattatcctgagaaatgcctctgacattttagctcctaccaccaaacaattaatgataccttattttgtgaaaagtactaaagatacaaagaagttacagctgtttgctcacaaaatacttaaaatgtagttaagagaaaaaaataatcctaaaataacttaatgagatgctctgagagttcacaaaggagtgatcacaagggaactggaacaatccaaggtggtttgacaaaaaaggcaggaagaaagctgagccccagaagacgtgaattcaaatacaaagaacaataataaaactctgtgaggccggacgcggtggctcacgcctgtaataccagcactttgggaggcctaggcaggtggatcacttgaggccaggagttcaagaccagcctggccgacatagtgagacaccgtctctacaaaaaatacaaaaattagccgggcgtggtggtgcacgcctgtaatcccagctactcaggaggccaagaccggataatcgcttgaacccgggaggtggagattgcagtcagccgagatcgcaccactacactctggcctgggcaacagagcaagaccctatctcagaaaacaaacaaacaaacaaaaaaactctatgagacaaggggccacaaggggaatgaatacttgcagagaattctccacatgggattcatccggaagaatattgaggtaaagctgaggaaatcctaagtcgtgtacgagaatctgaatatcgggggcaagaattggacatcactgtttaagctcaaggggaacctgcaagggttgagtaggactgttcttcaggagctggggctgaggagacatcatatgcaaagtagtatttcagatgcctaggaaacatccacctgccagttagaagcagagacccctcacagcaaaaccaccatagtatctctccaggcaacaaagtctgacctagctttgcagccgtggtaacaaaaagaaaaagacagttgcaagagtcaacagtagaaccaataggccctggtaaatcactgctcatcaggataaaaagaaagccaagtaaaaagtgactaaaatttcaagtcttagagctagcaccagttcaggaaggtagatgattaaatgatttttgtctaccttctagagatacaatggggacaagtgaaatttgattaactatgtttgcatgtcccccaaaaggacctactgcgccacttctaccacttcctagtaaatgccaactgagccaaaagtcaaatatgcaaattcaatctctaatctttaataaaaacttctaaagtgatggagattaggactcagaaagacaaaagtggctgaccagaagtcaaacgtcctttcgctggtataaaacaaaaacaaacacacagacagagtcccggtgccctggaagcagtggcctgggcggcgagtctttctctgcatgctactacttcagcttactaggcctggctggtctttggcgcccctctcaataaccccctataagcttagaatcccttgagttctgcagatttaagatataccaaagcagactgaagaggctgtcatttaacttcctaaaaataccacagtaccacagaatcatattgtacctagctcagagagactggtctccacctggtttgctaagactccagggtctcacaatagaaccacagctttccttgatgtcattaatggaaggaaactcctgctaatcgtaatggtcttacctttcaaaccaagtttaaaaattaaaagaaatgttttcttctttgtggctccttgcccattacaggttatcctggtaacagttttcctccaatttactgcattagcagattagcaggaatacagtgggatatggatatgaaacaagctctcctgtaaaagaaaaaaaaaagcagataatcacatatgttctcttttggtgtgatgatagctgccattaaagcatactgggtcagggtcttgggccacacagaactataccacagggaattaaaaagttctagttaatcactaaaatttttctatatgaacataagaaaaaaagcactgtcatctctctaccttagcttttatcctaccctaaacagtatctcagaagtaaatacagatgtcataatagcactatcaatgagtgaagaagaaaaatacatattcttacctttgtcttctgaaaacatcaattctattcttatccaacatagggtccactataaaggcaccacacttttactaaaaaatactaaaattttacaatttccttcctttaaatgccccctggcagtccacttaatacgttttatcaggaagcgtgagtagaacattaagatcactgaagttctagctgtactcaaattcagtctctagtgtcaattaaccaaacactgcacatgaaaagaatagaaattatctttcaaggtatgcacttcatatatagcttaatactgtggaaaatgacttaaactgtggacattgaactaattagaattcctctaagtagtgaagcctgacagggccaaaaaaaaagaaatcctctaagaatgcaatctacaaggcatttccaaaacaatgctgttcatctaatgcctttcccccataaaactcatactacattgtgatagcaacattttccctcaagtaagataataaataatgttaaacatttgttaaaatcaatcaacaaaaataacagtaacaggcctcggtgcaaattaaaacgagtatatttaattttaaaaataaaatattttaccagttaggtggtttttgactatacactgcaaaaagtataatcatccaaatttttgcttaaaatgagaacagaccatgtggctgtgctgctggagtccttagacaaaacagaaaggtcctgtatggcaaatccctcttccctccaatttaggatcatgtatcacatctaaagtcctatttccttaatttcctctcatctgaaacagttcaacgtttttttccattcatttcactgacatctttgaagaatatgggttatgtgcttctggcagtagtactacataaatgaagctttgtttctcctggagcatcacagaaagagacaagatgatgtcaatttgccccattattggtgataatttcaatcacttggttaaaattatatttgccagatttcttcactataaactgaggattttcctttgtaattaattcataatatgtagaacaatacttaagagactatgttcttacaacgttcatccagtagttttagtgccaactggcaattcttgtctgaatcaattgatattcagttatgaaaatgatgaggtttttgaggctctactgttcctcctgacattcaaacttcagtgagggatgctcccttctccccacttattctttccttatgtcatcagtatggactcatagattcgtattttattaactttttttttttttttgaagacagggtcttgctctctcgcccaggctggagtgcagtggtgcaatctcagctcactgcaacctccacctcctgggctcaagtgatcctcctgcctcagcctcctgagtagctgggattagaagcaaccgccaacatgcctgcttaatttttatattttttgtagagacgggatttcaccatgttggccaggctggtctcaaactcctgacctcaagtgatccgtccgccttggcctcccaaagttctgggattataggtgtgagccactgtgcctggccaattaacatcattattcattctgatgttcaaattgtcccacatttggccagtgggagccccttcctgcatgctcttgtgtgcttttcatagttctcaagcacttccttatttcctcatgtaacatgttctggatttgtcttatgcattctctgttcggctttgaaatctgccatttctccaaggagtcttggttccttttagtgggggatgtaatttaaaatgaaggtcttagagcaaagtacgttcatagatactgaggctgtcacttcctctgtccttttatagcaaacaaagctgggaaggaatgtcaatttcatatgctccaactctgttgtgtatccctgacttttaaatatgaatgaaaaccaaggattaccagacacctccagaaagcctctaccataaaaagcagcaaaacaaacagaaaaatgcaagttagaggaaaagaccatcagaaaacaggaaagaaaattgaaagcctaaaatggaacattttagcaacgttttccaacatccaaccaacaggggttctaaaaaaaaaaaaagaaagaacaaaaaaacagaagagaggaaatcagataaataattctcaaaaccgttacttaaaacagacccataccaaggaacatcactgttaaacggcatgaccctggcacaaagaagagcctaggtcttccataaccaaaaatctgaatagtttcagatttctcaagaacagaaaacaaaaaagtgaagtaacacatcacatccattaggatggctactataggaaaagaagaaaaaaaaacaggaaataagtgtcaataaggatgtggagaaactggaactcttgcgcactattggtgggaatgcaaaatggtacagcagctgtggaaaaaccgttaacattcattcctcaaaaaattaaaaatagaattactatatgacccagcaagtccacttatggttctacactcaaaagaactgaaggcagggtcttgaaaagatatttgtgtacctgtgttcatggcagcattactcacaacagctaaaacatggaagcaacccaagtgtccatcaacagatgaatgggcaagtgaagtatggtagagacggagtatcccctgtccaaaatgcttgagaccagaagtatttcagatttcaatttttttgcatttttaaatatctgcatatacataatgagatatcttgggatagggcccaaatctaaacatataattcagttgtgtttaaagtatactttatacatatatcctaaaggtaattttacacaatattttaaattaactgtgtattgtgtgtccatattgtgactgcaaccagtcacatgaggtcacatgtgttgtatgaggtcaggtgtggaaacttccacttgtggcatcgtgttggcactcaaaaagtttcagattttgaagcatttcgaaatttccaattagggatgctttaacctgtatatacatacaatggaatattattcagtcttgaacaggaaattctgatatacgctacaatgtagatgaaccataaagacgtgccaagtcaaataagccagtcacaaaaatgacaaaaatgtattttgaataaaggcagaagactatgtaattccaacttattggaggtactcagaatagtcaaaatcagagccagaaagcagaacaggagatggaggatggtgctgattgcacaatgttatgaaggtatactattaactgtacacttaaaaaggctaagatggtaaattttttaatatgtattttattacaataaaaaaatgataatggggcaatgtctaaagaattctgaagagatccgttctggctgaatgtctgtcctccctctcttccactcatatgttgaagtcctaactcccagcatggttatatttggagaaaggaagtaattacagttaaatggagtcacaagggtgggaccctgaattgacaggattagtgtccttatgagacaccacgtgcacatgaacccaaggaaaggccatgttgagaaagtctgggtcataatctcgaaagacacaatcctgaatgccacaatcccgaatgctgaatgctcatgtgcagtggattctaattattgactggataactttgtgaacattagaattctgggcgtgttttggaacatcggtttgcaagctcttccgagctggtatgacttttctttctcttctctatgttctcattgtttcaggattgctgcccccctaccgcctcacccctccagctcctggttctttgtcccagccatctcctgtggtactgtgctgtgtctgccttgtggagaccctgaggatgttctggatggagttaccaagcccccgacaggctggtccagttcctggcctcaacaaagtatgtgtccttttgcctcaggagaccagctgctccctaaaggctgcagcccccagcagagtttggcctgtttttctgcctgtttcacaagagagtgagcccccctggctccagctgcccacctgcacgaagctctgttaatggctgggacccccgaagcacctgggcccccagcctgttgctgggcctgggcttcagcttctctccaactcccatctactccacatctggtcctgggagatgttttctttccttctgagcctgaaagatcaaaagccctaaagtctaaaatcctgaaaattacaatcccaaaagatcaaaatcccaaaaatataattctggaaaaaaataatttaaaaaaactttcagaagacatgtatttctattttcaaagggggatttcaggccaggcatggtggctcactcctgtaatcccagcactttgggaggccaaggcaggtggatcgcctgaggtcaggagttcaagaccagcctggccaacatggcgaaaccccgtctctactaaaaatacaaaaattagctgggcgtggcggtgcacacctgtaatcccagctacttgggagcctgaggcaggagaatcacttgaacctgggagacagaagttgcagtgagccgagatcacaccactgtactccagcctgggcgtcagagcaagactccgtctcaaaaaataaaaaataaagggggatttgagaaacataaaaaaaatgagagaatacgtcataggtcactttacacaataaaataggcaataatcacatgcatatttttgcaaggatacaaggtataattcaagtctaataatgacagtcacatgggtagactaacagtcatgagcagacaaactacattcataaagaaataggttaaaaaaaaaagcaaaatgcataaatgcatataacagccagcatggtggctcaggcttgagatcccagagctttgggaggctctgacgggtggaatgcttaaggccagttcaagaccagctgggcaacacagtgagatcccacccctacaaaaaaaaaagtttttttcattagctggactttggagcaagcacctgcagtcctagctactcaacaggctaaggcaggagggtcacttaaggcccaggagtttgaggttacagagagatatgatcacgccactgcactccagcctgggtgacaaagcaagaccttgtttcattcattcattcgtacatacattaaaatgcgtataactacgggtggtaattgtatgcaatcagctttacaactgcagtcatctacaacctatgtcttttgatgagatctaccaaaaaccacgatggatcaacatcacatatgcagttgctcagagagctaagatctttaattttatctttcacaaatgcagatatacaaaaaaggacatctcttcatttactgaggaagtttcaactgttttacacatatgtacaacgcttacacacaaagtcaacactaaaaatgtacttttgtggagtcaaatgtgcaaaaaacgcataaaacaaaaacaatatatacaacttataccaccagtattgaatatgatgtgaagactaaatatatagcatagcaaactggcgctatgtgtgaatgggcagaagtcttataggactgaataatttggcagaagagatttcttgtagtttttgtctgtcttcactacgtctatgatcttcgaaacacctgttgcacttgtatttgaagagtggttgtggtcttcaaactctttaagtacatgctgtctgtttcaaagtctgttatgtccagctgttgcaattaagcaattttctgctttcatagccccaataataattaactttaacatttttatctttcaccattacgtagcctcatacacttatcacagcctttttgcaagggaacaatttcacagatctgttccattgtgttttaagaaacacagtaagaaggaatatttgacttccccaataccagatttgtattaagcttctccagcaagacagaactggtaagatatgtatacagatacatgagaggggatttatgcggggaatgagctcacacgattatggtgctgggaagtcccatgacaggcaagctgaagacccccgggatgccggtaacgaggttcaatccaagtccaaagggcctgagaaccagggacgccagtggtctctaactcagtccacaaaagcctcaggacccaagggggctgctggtgtatatcgtggagtccaaaggctggcaaccctggatttctcacatccaaggcagcagaagagtctggaccctggttgattggatggtacctgccaacactgagggcagatcttccccgcagcccactcagactcacgcattagtgagtgaggtattatcaattacaaaatagggataataactaataacaggaatggacaagcacttgtacaatgccagcacaaaaggtttgtaagggcagacattcatacctgacgttttgtgattaagcaagtgcgtttagatgctgtttgagaatttttccatctcctctgaaaacactctcacagacacacccaaaacctaatgtttcaccaggtttctaggtactccttagttaaggtgtcatctaaaactgagtccacaagtccacctattgtcaacctggcacccacacgcatctccttaaaccatacttaatttacgaataaagacaataacaaggtaatagttccgtctaacgtgatgcaactatcctacgcacaaccaaaaacatactgtcccttccccggtaattggctttcagggcttcaacactcaggattttaatcttttgtgattttcaggattttagagattatgatctttaaggattttgatcttcagggattctgatctttaggtattccaacatttgggattatggtgctccagactgtgtcatctggtatgatgattggcaccacatgtgagaagagatggtgtctctaaaccagaaagaggccactctctagaaaccaaattgtcaagaagcttgatcttgaacttctagcttacagaatgtgagaaaataaatttctgttgtttaagccacccagcctatgatattttgttatggcaaccctgagcagactaatatagaaggaaaactatttccaatccaaaagcatatacacagtcaaactttatcaaccacgagtacacagaaagacacacagtctcaacaggtctagctcctatacacctttctcactgaaaactactggcaactatgctccactaaaactaaggagagcaacaaggtaacacagaacacaggaataggagatccaatggggagaaagaggtaaaaagaacccccaaggtcacagaatgggagagccagcagtccaaactagaaagattccttcaaaaggataaagatgagggaagatctgaatatgtaactggctaaaagtctgaggctaaattagtgataagtacatttaaaaaacacacacacacacacacacacacacggctgggcgcagtggctcatgcctgtaatcccagcactttgggaggccgaggcgggtggatcatctgaagtcaggagtttaagaccagcctggcaaacatggcgaaaccccgtctctgctaaaaatacaaaaattagccaggtgtggtggcacacacctgtaatcccagctactcaggaagctgaggcaggggaatcacttgaacccaggaggcagaggttgccatgagctgagatcgcgacactgcactccagcctgggcaacagggtgagactccaactcaaaacacacacacacacacacacacacacacacacactctaacacagtaacacatttccagaggaaaccaaaagttgtttaggaaaggaaagtatttgtaatttataccatttaacagctataaatagtatacatgggccgggcgcggtggctcatgcctgtaatcccagcactttgggaggccaaggcgggcggatcacaaggtcaggagtttgagaccagccttaccaacatggcgaaaccccgtctctactaaaaatacaaaaattagccggacgtggtggcgcgtgccttaatcccagctactcaggaggctaaggcaggagattcgcttgaacccgggaggcagaggttgcagtgagctgagatcacaccattgcactccagcctgggcgacagagcgagactccgcctcaaaaaaaaaaaaaaagtatgcatggtcgtaatgtagtatacgtggttgtaatgaaaaaactaaatagtgatttaaccaaaatgttaacaaacctctattgggtggatagggaagagagaaaacagggatgaaggtgcagtaaaggagagaagagagagccaatccttatcttccatgtcagaaaatcaatagacactggttagaactaaaaaaatcagaaagtatacacacaagtatgaacccttcaaatacagtcttcagacatatggaggtaaataagtatttttaactggttaaaacagtccaaagtattacactatctccaggaaagggaaaaaaagagagtgggatacttaaggactcctgtttgtcttacccaatctagaatagttgactccaaaatatggacatataaagctttagtttaaagaaaaacctagaagtttttaagaaaaaatgctggggctcatgcctataatcacaacattttgagagaccaaggcaggaggatcacctgagcccaggagttcgagaccagcctgggtaacatggcaagaccccattctctacaaaaattttaaaaatcagccaagcatggtagcacacgcctgtggtcccagctactcgagaggctgagacaggaagatcacttgcccaggaggttgaggctacggtaaactgtgtcgcgccacagcactccagcctgggctacctaacaaaaccctgtttcaaaaaaaacaaagaagaatgttggactgggaagaggtattaaatgttgagagaccagagagctgtaatatcaggtcacacaggtaatgagaagctaagacaaatcacttaacctgagtatcgatttcttcatctataaaataaaataggccaggtgtagtaggggctcatgcctgtaatcccagcactgtgggaggccaaggtgggccaatcacttgagctcaggagttagaggacaccatgagcaacatggtgagacccccacctctacaaaacttatcaaaaaaaaaaaaaaaaaaaaaaggccgagcacagtagctcacacctgtaatcccagcactttgggaggtgccaaatcaggtggatcacctcaggtcaatagtttgagaccagcctggccaaaaaggtgaaaacctgtctctacttaaaaaaaaaaaaaaatttgccgagtgtggtggcaggcacctgtaatcccagctactcgggaggcaaaggcaggaaaatcgcttgaacccaggtggcaagggttgcagtgggccgaaattgtgccattgcactccaaactgggcaacgagagcgaagctccgtctcaaaaaaaaaaaaaaaaaaaaaaattagccacatgcagtggcttatgtctagtcccagctactcaaggggcggatgtttcaatgagccaagattgtgccatagcactccaacctgggtgataggagtgacaccctgtctcaaaaataaaaataagagaggtggggtaaattaactctaaattttcttgttgcttcaacaatttatgaatctaatataaaaataatcaaagctttaaacatggtaccagtggctacagaaaaaattaagcaggacttggtaaaaaaaaaaaaaaaaaaaatagagaagtaaaataaaaaaataaaatctgctttaagcccagagggactgagaacgtactgatggtgaaggagaagtcagacaagcacggttgaagaaatcaagatccaaggtttcctatcctcacagggaaagaatttaactgacagtatccagacatactacagcacaacaccactaaaaaaagctaagccacaaagagatgctttgaaagttaaacacaaacagatgagggtggaatccataaggatgatgaaaggttctccctaaagaacactaaaggtgaaaacgggggaattctccaagtatttaatttctatttacatcataatcaaaggacagggtgagaaaaggacacggttagagtaagactactctgaaacactgggagctgctgcacagcatcatggaagctaacgaggaagactatggttttaatcatcaataatatcagatgtggttcagtagttgacagcattagactattctcttagaggaaatgaatccaaagccctctctccaaaaaagaaatcaagacaggaaaagaaaatagtatacttttatttgcagccaatcattccttcaatacactgcatttttctcaacagtcatacaacctaaccctgtcacacaacctaaccctgtcacacaacctaaccctgtcacacaacctaaccctgtcaaaagatttctcttcttttcagtactgctgactctgataacaccaataaagagaatgcaagtgtaacataatataaaaataacatttaagaatgaggactgctttggactaaaacaccaaaaccacaaattctcaactaaacagcatctaagtgaacttgcttaatcacaaaatttgagagcagcaggaatgaaaactatccttacaaaccttttgcgctggcactgtgcaagtacttttccatcctattattatcatccctgttttatagtctaggaaaataaaggatttaccccaaatcactcttatatggacactaaatttatttaaaaacaaaaagccggccaggcacggtggctcacgcctgtaatcccagcactgtgagaggtggaggtgggtggatcacgaggtcaggagttccagaccagcctggccaacgtggtgaaaccccgtctctactaaaaatacaaaaaaaataagccgggcttggtggctggtgcctgtaatcccagatactcgggagactgaggcaggagaattgcttgaacacaggaggcagaggctgcagtgagccaagactgtgccactgcactccagcctgggtgatggatcaagactccatctcaaaaaaaaaaaaaaaaaaaaaaaaaggccaaaaaactcacttaggccggggaaaaaaagcagtagtaatctgctccctatcctctcatataaatttttttttttttacacatgaggtgttgctatgttgcccaggctggtctcaaacacttaggctcaagcaatcctcccacctcagcctcccaaagtgctaggattacaggtgttagccacctcacccagcctcatataaatttctaatataaataccatgatattcctgatgtaaactcataagaggaaatcatagctattgcataacatgcaagaaagcattttctcctgagagcacatatcatacacaactaaagatgcactctccattagacagacaggtggtatatcacaaagcttggatacacaaaagcaagaaacactagtttttaactggcatcaggaagtcccaggacaggccacctcagaatgccctcctaatgcaaatctcaaaaatcccattgctgcaagtaccctcacacgttttctaaagcacccaagtttgaagagatgaaggtaatgagatgggaagataattcatctctacaaggacttgttcaccatttttaccttcaatgcctagcacaccgtaaatttaaaaatcatccacaaaattttgaatacaaaaatcatcaaaaataactgcataaatgcccataatcaggcaacaaccaacttccatgactgttgataaataacctaattcccatgtcttcagaggcatcttccaacaaaaataactatagacaggcaactcaatcagccaatttcagaaacaccaaccattttagtacagcccgaggtaggaacaccaagacttctaagccgttaatcaataatcactataccaaaaaaaaaaaaaaaaaaatgcaaaaagactactgtgaaaagtacaaaacacccaaagtaaatccatactatcacctcctaaaagcaaaatcatgtatgtaaagtacttgaagtaaagactttggcacctaattggactacatcattgtttggctatgcaccctaatggacactcaaatcactgcaggcatatatgaagccaacacaatctaagctgctattaaaacagagccaagtcataaattagtacatcaacatctagaataaggcccaaagaactacctctgcctgttgtaacaacagtgggcagggacgcacagcaaaggtacaaatgactacatgatcccaatcaccgagctacatttagtgggctcagccaaggtatacaatcaagcttaatttgatgtaaaagctgaaacttccataatccatagtacaaaggtaaaaaagaccaaaacttcttatatggaatcttggcaatcaaatggttattatctgagataagtgtacaaagattgctgaaaggtgagaggaatggggaagatgatggtcaggggagacaaagccttaattaggaggaaaaagggttttttttctttgagatatagtgcatagcatggtgaatgtagtaaatactcatcccactgtgcatttcaaaatcacaaagagaatttccaattttcttcccacaaaaaagtgtttgtggtgatgaatgttaattaacttgatttaattattctgcattgtatacatgaatcataacatcactttgtaccctataaataacagctataatttatcaatttacagttaggaattttttttttttttttttttttttttttttttttttgagtataaagggctgggtgcagcagttcatgcccataatcccaacaccttggggactgaaacaggaagatcacttgaggccaggacttagagatcagcctgtgcaaaatagcaagaccccgtctctactaaaaatataaaaattagccaggcgtggtggtgcatgcctatagtcccagctattcaggaagccaaggtaagaaaattgcttgagcacaggagaactcaagcctaagggtgggatttttattaggttggnccnnnnncnnnannntnnttnnnnnnnnnnnncnttacttctttttttcctcttttccccttccttctcttcttttttactttactctttttcctttttatcttttccctcatttccctcctttttctcgttcccttcttcttttctttcttctttttatcatcactcttctatcttcttctctcttcttcttctcttattttcatattcttattatcttatcctccattttcatcttttttcttcttattttcttccattctcttcttttttcttttcatctctttcactctctctctatctcttttttaattctcccactctcttctctttcatctcttcactatctctattattatcttctatctctcattcttctctttcatttcttccatttttcctcttttcctttaactcttcttttttctctctctatactcttttatatattattcctttttcttccattcccctcactctatcttctacttttcttcagtccttatattctctctttctttcctcatcctcttccttatatttcatcctcttctctattcttaactcttcttcttacatcattcttctatctctaatacattcactcattttcttttctctcttacttcttctatttatatcctctttttcttcctctattcatcttattctctctcttctcaaccctctatacatctcacnacatcttacacactcctctactctctacattctttattctctatcactctacatcctttcctctctctctcactcccttatcctactctctctacatattactctgact

SEQ ID NO: 20 - DNA, 33308 bp, Homo sapiens
  unsure (26738): Identity of nucleotide sequences at the above locations are unknown.
agctactttatttctagcctgctcttgttaaaacatatatttatagagatatatatttatttatttattgagacagagtctcactctgtctcccaggctggagtgcagtggcgtcatctctgctcactgcagcctttgcctctggggctcaagcgattctcttgcctcagcctccccagtagctgggatttcaggtgcacgccaccatacctggctaatttttgtatttttagtagagacagggtttcaccatgttggccaggctggtctcaaactcctgacttcaagtgatctgcccgcctcagcctcccaaagtgctgggattataggcgtgagccaccacacccagccaatattggtaatattttataggcatgtcaccaaacagttccccagacggcagtggctgtaggtaatacaaatagtgaacactgactgagcacttgctgtgggtggcttgctaactgctggattcctcacagcaacgcattaggtttggtgctaggatgacccccatttgacagatgagacaggggctgggtaacttgctcaagatcacacccagctcactgcggtgggtctgggattcacactcagctctctagctgcagaacccatgcttacaccccaccccaccaccaagctgaactgcctgactgcagcaggagtctccagaacctgttttttatttcaagcatagtaagaaatggagatgtgcttatgtcaaagaatatggaataggccaacgattcccgtcttaaacatcctataacctccacatagaacagagaccacacgagacgctgctgggctggctgggagagaacctagagagggggtgggtaaggggaaaggatgcgaggcctcatgattctagagacatcactttcagatggagatagcatgagctaccgcatttagaaatttattacttccagatgtggctgcattaaagacgcaagcacaccacagccccaggtccctcccaccacccccagcttcgctccaacccatgtggagccctggaggcctgactctctgggttctcacgtctccaaattcaggatgcccgggatgggtgggaccaggagcgctcagcccactgggctggcgccccctgctgcacgcggagaacacgatgggggagctgggccagcacctaccagggcgctgggcacctgaggggttttcttatctccagatctcagagcgactccctgtaggactcctggggaaaatacttagccgggtcggattacaggtttgtatcttgtcacttgaagccctaactcttcttttggaaggatggctctgtctttgtgaatgaaccaaaccaggggcctggcatcatctgagagcccctcatccccacgcccaggcccttccctttgctggttccttcgctactctggctccaggaccctgtcccttctcacctgggtagctcccagcaggccctgctgcctgcctcagccacccctatcgatcccagcagcccaagccctctgggtctgcctgctacttccaagactgagttcagcacagcctgggcctctgctctgtccctgctgttgtcagctcccagaatgtgctgtgcccactccccagctgtccctcctcctgtcctgcccagccctcctggatgcctgctgcgctgtgtcactccccctgcactgtgatccctgcccctgctcgactgtgtgaggcagaagggccaggagcagggacccgaggccacctgctctgaaccccagccttacaaaagccccgctggcgacagatctgtttcgattactcagatggaatttgctgttcttgtccatctcgtggaatctaggttgcgcctctcttgatgtcagctccaagtcccagctgcgtccccgccccactcccctgggccctgccgccgccacatggggtggagggctgccaagaatactatttatccagccctgggagggccatgcttgtcattctccccgagttcctgttttctctggctcgggggcctggtgcttacagacatgctgctccagttaaactatctacaacaggcatgcacggctttaaaccagaacacagaaacctggtctccttgggaagcaggagtttatttttatccttttgtaagtattaactcggtaatcacaacaaacacggagcaatctcaatgctgtttatccggaggacagtctgcggggtcgtgacgactgaaagaaaggatgtcacaggcttgaccacagaccctgactgttgtcatcagttacagcaggggctttgcacacagccctccccagccagcgcgaccccggcaacgtcccctgctgcacatggccgtgtttatctccaggtgtgcactgactgcctcgctagcttgttcgttcactctgttggcaggtgcagaggctgggacaccagacgcctcatggccaggagtgccctgcgctggcacctcacctctcctcccacactgtctatgctgtgacttctggagtgcgtgggaggatggccccacctgagtgaccttgaggctacctggaagtgtcagaaggtacacgagaggctcccctacccagatgactctaaggtgacagccaataccagtattctgggtatatttaactatgcccactgttggtggtttaggccggcaactgcagttatagcaagagctgtgagggacagaattctgcagccgctcagctatgtggcccatgccccgtgggtgccatccctcaggatgcccactgtgggggatgtcctcagtgcagacctgctaggacagccctacacctgcttgcggattcactgctgctttggggacagtgctaggcatcatgggttggaacaaagtggggtcatgcgtggagggtggaggagaaggggagcgaggtggggtcacgcgtggagggtggagaaggggagcgaggtgggttcacgcgcggagggtggaggagaaggggagcgaggtgggttcacgcgcggagggtggaggagaaggggagcgaggtggggtcacgcgcggagggtggaggagaaggggagcgaggtggggtcacgcgcggagggtggaggagaagtggagcgaggtggggtcacgcgcggagggtggaggagaagtggagcgaggtggggtcacgcgcggagggtggaggagaagtggagcgaggtggggtcacgcgcggagggtggaggagaaggggagcgaggtggggtcacgcgcggagggtggaggagaaggggagcgaggtggggtcacgcgcggagggtggaggagaaggggagcgaggtggggtcacgcgcggagggtggaggagaaggggagcgaggtggggtcacgcgcggagggtggaggagaaggggagcgaggtggggtcacgcgcggagggtggaggagaaggggagcgaggtggggtcacgtgcggagcgtggaggagaaggggagcgaggtggggtcacgcgtggagcgtggaggagaaggggagcgaggctggaccctctgggtgctccctctaggatgagggtggcaagtgggcagtggcagccaggttgagacctgcctgggcttcctgtcccgagacccacgtgccccacaccctccgtccgcatgcgcctgggcaaccagcaccgtgcaacagggcccagcggtactttctctaacttacttcttttcttcttgaagtttttccttttcctgaatctcataatgattcttggccatgattctgtcttttcaatgactgtggcttctactcgaacaagatcctttctagaaggaagaaaaatcaacaataatgtaccttttggattatttttcaaatgccttaggtgagaatttctaaaatgaagttatactttctcttttgttgattataaaagtaatacgccctcaatggaaacattttgaaaaccacgaaaaaggaccacaaagaacagttccagggagtctgaacaaatcttcagaggaccacactgtcatgaaacagcaagagaccaataatttggtctggatgttctcatgggccctaaatgtccactattattaagtataaatgttgtgtttggtgtcaacaaagaatatgaatgcaactccccacctggcctaattgcactgtgaccactgtctgcatgtccagccctggagccccagacaaagcccagcacttcacagccattacccgaggagtggcttgccaagcagcgtgaagttgtctgccccaaccagcaggacctgaaaaattcaacaggtgtgtttcatcagtggctcattacgatgagtaagaacagttgctaataacaggtagtgatgtcaacaccacacaaaatgagaaagactgaaaacattgtgacatgaatttcatctgctgtctaatgatctctttaatatctacaaccggggctgtgagctgacaagtggcagcactgcacagccgtggggctgcctaagggaaatgctccaaccctcagaggagacgcacaatttgattattagataccatggatatgcatccagatagctgctgtaatcctcataccaacggtgacttcaaaaaccctttctatctccggccaggtgcggtggctcatgcctgtaatcccagcactttgggaggccgaggtgggtggatcacaaggtcaggagatggagaccatcctggctaacacggtgaaattagtctctactaaaaaaatacaaaaacttagctgggcgtggcggcatgcacctgtagtcccagctactcaggaggctgagattgcaccactgcattccagcctgggcgacagagcgagactctgtctcaaagaaaacaaataaacaaaaaaaacaaaaccctttctatcaaagcataacatagagagaaaaagcacaaatcataccatcgtgtctcttggcgcagtttacagttctactaatattgcaatgattgaggctctcctgtattcttttaacgactgcaaaattctcaagagccaggcaaccattctcaatgccgggaaatcacgacaccaagtgtggctgcagatgaagacatctttgcttccaaatgcaacagtgttctttcttctttttgtgacccagagtctcgctctgtcacccaggctggagtgcagtggcgtgatcttggcttgctgcaacctctgcctcccaggttcaagtgattctcctgcctcagccccctgagtagctgggactacaggcgcccaccacaaaccccggctaattttttttggtatttttattagagatggggtttcaccatgttggctaggctggtctcaaactgacctcaggtgatctgcccgcctctgattcccaaactgctgggataacaggcgtgagccaccacgcacggcctacagtgtttttattagatgttggagttcatcttaaattttactgataagaaaaaatccaatcatactcaacttaaatgtctagagacaaagtatatcatataacaaactcagcggatacgcatgttagatagtgacaaataataaaataagtatttttagagtttgtttcagcatgacatgtgcactcccactgggtttcctgttataaaaaacaatctgcttaggaggggctttctagaattttttgttaatgtgaaatgtttcaaatatgcaaacatctgccttcagaggaggagctttaattcataaagaaaaccatgtaacttatattgataattaagcatcccagaaaaattacctgttgcagaggtaattataattttataaaaagagtgggcaggccgggcgtggtggctcacgcctgtaatcccaacactgtgggaggccgaggcgggcagactgcctgaggttgggagttcaagaccagcctgaccaacatggagaaaccccatctctactaaaaatacaaaattagccaggcatggtagtgcatgcctgtaatcccagctactcaggaggctgaggcaggagaatcacttgaacccggaaggcagaggttgcagtgagccgagattgtgccactgtactccagcctggacaacaagagcaaaactccttctcaaacaaacaaacaaaaaaaaagagtaggcaaaaatcaaatagacgcccccagcaaatagaatcatagctgaaggctagaaatgcctagctaaataaacagactggccaggcacgttggctcatgcctataatcccagcgctttgggaggccaaggcaggtggatcacctgaggtcaggagttcgagaccagcctgaccaatatggtgaaaccccatctcaactaaaaatataaaaattagcaggggcgtggtggcatgcacctgtaatcctagctactcgggaggctgaggcaggagaatcacttgaacccaggaggtgggggttgcagtgagccaagaatgcgccattgcactccagcctgggtgacagagcgagactgagtctgaaaaataataataaacagacaaaccatgcagttttttttgagacagggtctcgctgtgttgcccaggctcgagtgcagtggccaatcacggctcactgcagcctcaacttcccaggctcaaatgatccttctacttcagccccacaaatagctgggactacatgtgtgtgccaccatgcccacctaattgtttggaattttagtagagatgaggtctctgaggtctcaccatgttgcccaggctagtcttgaactcctgagttcaagcaatcccccaccttggcctcccaatgtggtgggtcaccagtgtgagccaccatgcctggcctagaccatgcagttttgaatggtcggtgaggtaaattagcacccagggaaatgcctgtcaaccagtgtttactatttaaaaacagcagcagctgtcaaagctaatgacagagtactgtcttagcagaaacttaacagttttttcctcatagacaggggctataaagtgcactacatccttaaccgggatttttattatctttgcaatcaagcatttttctatgggaatatactaataagactggaacacaataaagacatgtttctgccctcagcactgttttatgtgctgtctcccttcctccagggagcagacctgctgggccaggcaccgccctcagagcagtggaagcctgccctgcccttggaccccagccccgccgtgggcgccccccaaagtcccttctgagcctcagctttgttggcctccacctgagacggggtcggcgagggtccctcctccgtgtgagctggggcgtggagattacatacttggtggctgagtccctgaatatccagagaagctcggtggtctcaccttctccagtcgaattctctctccacacgcaaggtctagttcatttccaattaagatcaggtcttcagaggtcaccttccactggcggctggcaaagtgcaccacggcaaagagcctgccatactgccccgtgacgatcatctcattcaccttcttcacgacctctgcaggggaaggcgggtgggtgggcagtcaccctcacctgctcccccacgcgctgcagtgtgatgtgcagctcctggtggtggggccctagggtggacctgacagccagcaccccttgtgagcacctcactgctggcggcccagcccctgctccaccccctgcaggcacaagggcaggcacagggtcagtctgctgcttcaggagcaccagcactgtggcacatggggctttcacaaaagggaagctccccaagactgcagagaacgcccaaaccgcctcatgcaactccctcgcctaagcactcggcacgcctggctaggtttctacaactctaggggtgggcgaaaccttccacctggttcattctcatgagaatgaggagccagcagaccagaagtgtgcaaaccccaggaagcgaaaggagaggattttgcaatgaggagcccccggtatcccaaccccatatcccacccctggggcaggacgcgttccccctgcacgcctgtgcccagaggggctccgtgctcagttcctgttatctctgctctgacccaggtcacagtcccctctcttctgcaccgtttactctgaacaagcatttaatgggcaccgaccccccggcctgaccgagggcgagacacacagaagggacgacagagtgcctgccctggaaacactgtcaacaccagaagcaccagcaccgagggtgaaactcttggcagacttgtttcactcgcacggaatctcaaacggtatttaacatataagaagattccactcgaggatcttgatttccagtgttctggaaagcgaggatcatggcaagagtggctaatgatcctgtcccttctgacacgggctccaggtcgacatgagtcctgatacctctgcatgtttctccaacagcccgggtggcaccggcttccagtaattgtgcttaactgtgctaactggggagagctgtcgctgcacccaccaacagaagcagacgagatggagcaggggccccctgccctcaattatgccacctgcctgcagtgtggcaggtgttcaaggagtagttaatgaaaaacatctgaaattctggtgttaactggtgaaaatggacatgagtgctggcactgtgctgtgtctgggagcatctggaaacatgaagcctcgttctgtggcctggtgacaacctctgtggctgactggagcagggtctaggtggtgccctctagcttctgtctcccagggaggtcttacctgcatggtgtctggtctcctcaactgggtctggcagaacaacttctggccaaggtggtgaactcagggatgttttaggaacatatctgtaaaacacatttcgtagacaaatgtcacaagcacctgaaaaggcagctcaaatcctctaagaaatggccacacacaaatgttaggaagggatccccggcaacaaaaggctcgctctttcggacaggccccgcccctctggggtaaccccgaggacaggctccctgtatccttttagaaccacagggaacaatggctcatcattcaataatcaaagcaggaactctcattgttctgcaaaagagccctcacttgggtacttctcagtgctggaagggtgcccatccaagaaggctgggcttgtggtgtcttggggcacatttatcttggaggcacaggctgcctctactttccccacaacccaggacacagggccagcagctctcccgcctcccttggcatccagtggccctggaatggcagctccaatgacccttcaccacatcctgctcaaacaggaccatgacgttccctgctccacctccacctcctcctaggtaggtgcctgctcttccttcacacccaggtgagtgccaggcagaactggctcggaaccccagacaattctgtgttctggtgtctacaactgagcaaatgggaaaacaagcacccgcctgaaagggctgtgttaggtattagatggctactgttcacagccggtcccagcatggccagtgagggtcgggtgttaggagtgctcagtctcagcagctatagcactgcggtccccagccacttcccctccccaccctcaggatgccaagcttggtgcgggcaatgccttttttttttgagacggagtctcgctctgtcacccaggctagagtgcggtggcatgatctcagctcactgcaacctctgcctccagggttccagcgattctcctgcctcagtcaccttagtagctgggattacaggcacatgccaccacatctggctaatttttgtatttttagtagagatggggtttcgccacattggccaggctggtctcgaactcctggcctcaagtgatccgcccacctcggcctcccaaaattctgggattacaggcatgagccaccgtgcccagcccaagatcttcttcatttcctaactctcccctgcctgctcagcctcaggtaggtggaggggagaggaagggaggaaagaaagaggggggcctagattcaaaaggaggtggggtctttctttctgtagtctacaaagagggagggtaggtagatcccaaaccgaattattcagaaccgtttttaagcttttattgctgctgccactgcaaagtaaaatttcagtctttctactccagggttgcattaggaggaagaaaacgacttgctccatatgcaaaatgcaccggcctccacaccaaagaccaggcccacccgtcctgttggctggcgcgcaggaggggctccacaccaatctgggagaggaatgaatgctttcccagtggggtagggcttggagctcctagagacatgaactccgtgatctgtggttggtcaatgaccttgagagacaaggaggacaaggaaggtgctgctctctacaaaacgtctttgacctgtttgatgtctagtctccccatacgggttcagcagtgcccagtgtgagaagaacacgctggcaggaaggtgctaacctctcacacaggacacaggggtagtaggcacaacctacccacatgctcacttacaacttcttcctatgctccgaatgttttgccgcttctttgagaagcaagaaagactcccacatctccccactgcagaggatccctggagtcccagcagcagttccagcagccaatgttttgtgagtgctgactgtatgccaggcactgttctaagagctttaaatgtatacatttacttaatcctctccaacacccatgcagatagaaatgaacattacttccatcttgcagaagcctggcgtcccaggctgtgaggggcagccggaactgcaccccgggggggtccctacagtaactgctatccctgcactgctcctgtgtctcccaccagtgagtggaactttgtcgaatgttttctgcagtttatgatacctaaaaatgttttctcaagtataaaattttaacactgaatgtgctttttcaaataatgagtttctcttagagactctgatacaaacttcctcatcagaaatcttgagttaagacttcaagctcctccataataaaagagagcaaacacatacagaatttctctttggtctcttgcagttacgtcttcttttaagggtctcagaaaaataccgtcaaaaaagttaaagctgaaagtggtggtgcatgcctgtaatcccagctactcaggaggctgaggcgggaggaccactttaggccaggagttcaaaaccagtctgggaaacatagtgaaactctgtctcttaaaaacaaaagaggaaatttaaatattattgagaaccaaaaggtaggaagttttgactttagaaagatggttctacaaatgaaaggaaaagaggcaccaaaacccacattttgatattaccctggtagatatgaagtgctctgtgaattgaaccttcgagaagcagaccaaagggaggctgagggaagaagagaaacacagatcattaccattaatactacaaatgcaaactgccctttatgatgctaaatgcacagctgctgctcctggtacatggtatgaaccactgcatgacagcctgcccacagaaacgcctaggtgagcaaaactacaagaacgtcacttacagctactggttatatgtgttgagatcagttagccacatcatctacaagcgcctgagaccagaaccacccgtccactaactcatgccttgactaagtgcctggtaggttcagactctgatctgtgcccaagcgtgggagcagcctccaagatggccctgctgggccccgcctcctgctattcttacccctgttagacccctgggagtggcctgtgtgtccaacagctagtgacagacatgctagcacgtggcttctgggatgaggtgataaccaactgggacttccatcttggatgcctgtgctcaccctttctgatctctggccttagggctgccctgctgtgagcagccctacctagaggtccacatggcggggaactaggcctatcgccaacacccatgggaacgaccttgcaggtagattctccagccgctggcgcagtggagtcttgagataactacagcccctgcagacttgcttgctgcaagctaagaccctgagccagaaccagccacttaagctgcttctgtgttcctggctctcagaactggtgtgagttaataaatgttttaagctgctaagttttggggtaatttctgatgtaaccgtagataacgcatacaccaggaatacaccaggaaacaaagacattcaatctactgagaagacaggggatcaaaataagtgcttaggtgtaaaaagcagagaacagtttctcaataaccacttttaaagaaactcagctataatttacacaccataaaaaccacctttttaaagttcacccattagcaccagctccccatttgcatctcctcggctgctttctcctctcctctcccatttgggcatccggggctcaacccttggccttgacctcctctccgcccatggccattcctctggtgactgcatccagtccgatggatttaaacacccccaatgtgctggtgactcccaagtttacacctccagccaggggttctctcctggttttgcatacccacctatctatctgccttagccactcgtgtctgacgagcacctcacacctccagaggctcctcatttcttcccatgcctgcttctcccacactcctccctctcacatgagggcaacttcatcctcccagttgctcaggccccaaacctccatcagttttgactcttctctcgcacactactcagtcaacccattggcaaatccatcccactattaaaaacttagcaggcttctgtacctaatttgcttcaagctttgtttttgggtccccagggaacaaacagtctccttcctctcccacaggatttcctttaggtagtcctagagactgtgactgtgtacttccatcacgtctcctttgctcactcttcaaggccccagctgctcactgttttggtcaccttgtctctactcgcttcactgtgtgtctttctctcctaacgcgtgagtctgtacttgaacatagcattggaggggtggtttcatgtaggtaggtagaatggagtaagtcccactgcttttgtaaaaactttcctgcctacttaaacctaagttttattatggaaaatgtcaagcatacaaaagtaaagagaacagaatagtgaactctctcaattatccctttccaggttcaacagttaccaactcatggccaattttggcatctacattgcctctggcccaactctgtgattattattaatttcttaatagactttattttttagcacagttttagtttcacaccaaaattgagtggaaggtacagagagttcccatatgtcccctgtccatgtgcccacagcttcctatcaacatccctcaccagagtggtacaatctttacaattgatgaacctacattgacacatcattgttatccaaagtccatagtctacattaggggttcacccttggtagtgtacattctatggatttggacaaacttataatgacatgtatctaccattatatcatacagaatagtttcactgccctaaaaatcctctgagctccacctatttatccttttctcccccaatcctcttaccccccatctaactttttactgtctccttagatttgccttttccagaatgtcatagtgggaaacatacaagatgtccccttttcaggttggcttcttttacttagtaacatgtatgtaagtttcctccatgtctcttcatgactcatttctttttattgctgcataatattctactgtatggatgtcctacagtttatgtaaccattcatctcctgaaggacatctgggttgcttccaagttttgggaattatggtactattcttttaatatcgtccaatatagagttagatccagttttccatttttgggggtcatggtgagacatgaaacccaggtttaaaacatacataaacactcatgcacacaaatacacactccaaccattttcaagcagagatttatagagtttttaacgaacataacctttttggagcctcgtatcagcccagcgccttaaatacggctgtttcttttgcagaatgagttcagattaggcgaggatatccatcaccatttttcagaccagctcgcagcctgggggcagtggttcaagcacaggctttggagccgaaatgactgcgcctgaagtactcttcttccacttccccgctgtgtgaccctgggcacgttacctagctcctctgagcctcactcttctcccccataacatagggcctataccaaagttcaagggctattgtcagtattcaggctactaactgaaggaatcaaaatctgaacctgggttcccccgactccaaaacccgtgctatattcaccacaaatgcgatcaacacacaaggcaccgggtcggacccaggcacatacgtggcgagaccgcagggagcagcgctcgctctgcgtcctcccttcctcccatatcccaggtctcacctgctccgggccccgaaggtctcaggatgctgtggctgcacgcggacgccagccgccctaaggtgaccgtcagggaagatgctgccatggccgccgccatcttcccgcagcctcggccggaaacggaaacgacgcgaaccgcgtgcgtaacgcacgggcccggcggggaacaccggtccgctgtaacaccggcccggcgcagaagcgggacgtcggcttataggggcccaggccggcggcggcgatggcctcggcagctgtggagagcttcgtgaccaagcaactggacctgctggagctcgagagagacgcggaggtggaggagcgcaggtacgggaggccgccggcgccgctccctcgcggtcggtcccgccgtgtcccgggcagagtctccgaggggctcggcctcatagtctggggcgggaatttcgtctccgacccttcgagtcaggggcagggatcgtccgtcccctgcttggccacctcccgagttgtcagtctcatcacttcctgggcagcgcgttccgtttggggacccttaagaagcactttgatttcccgacccgagaccccccactaagcttacactcttgggccctggccccgaccccagttccacccgcagcgagttagcagccctttcccttattcattcagtaaacatggtttgcgcccattctcagtcaggccccggcagcatgagtcaggtgcactggctgcccccgatccggccagcggcgggctgggcataagcagagagtcccttcccctccagtgcgtccagggccggctgcgtgcgtgtcgcggggaaagagcctggaggaggaaggcccttccctggggagggtcatggtggcttcaaggagggagtggtgcctgaaggaaaattggagttaagctggtgggtgcggggtagggtggggagccgtcctgagaggtgtggggagccatgtgagagccgggcttgtttccgaatgggactatttacttgtccaaaacaatcagagctaacacttacgtactttccatgcgttaattcttttacacctcatcccatgccaaccctacagtgtaagtttcttttttttctttttcttttctttttttttttttttttttttttagacagagtctctctctgtcgcccaggctggagtgcagtggcacgatctcggcttactgcagcttccatctcccgggttcaagcgattctcctgcctcagcctcctgagtggctgggactacaggcgcgccaccacgtcctgctaattttttgtatttttagtagagacagggtttcaccatgttggccaggatggtctcgatctcctgacctcgtggtctgcccgccttggcctcccaaagtgttgggattacaggcgtgagccaccgtgcccggccgcagtgtaggtttctgttactgtcattttccgtctaaggagatggagacagagaggggttaagtaacttgccccggggtgacacagtgtagcccgatttgctgtcaggcagtctgcttccagagtttgcagtcagccatatgtgggtaggatttgtctgagatgcttttgatcatggcaatggagagcttttgcagttatgttgagtttcttagaatcccagctgtttcatttatgcctgtgtgactttgcaggttctgtctctgagccttacttacttcatctgtaaaactgggatgattcccacctcacaggcttgctctgagaatgaaacgatcccctgtcagtcaggtgctcagcgtggtgccaaggacagagtcagcccccatggcagtggctctttctgaggatgctgagcagactggcagggcgagcctgggaagggcctggctaaggagctagtcttctgttctgtgtatgaaggatgggccatcagcggggttaagcaggtgagggaggcgaatagctttgcattttaggaggatttcttgggtctcctgcttttgattggacgtggagaggccagaggtaaggtagttgagaggctctgtttagtccaggtgagcagtgatgtggatttgaaccggggctgtggcagccaggatgagaggcagagaagtccaggtagaaatgggaggggcctgataggacttagtgacagatgggaggagagaggggaatgctgattgaaagatctgtctcaggtaactgagagaagggttgtggcattaactgccctagggggatgtaggaggagcgggattgggagtggagccaattcggagttccattgggacatatttagtgcctgtgagtagatctttatctatgtttctttctcttttacttttcctgggtgggtggaagtagaaactagtaaaaatcctgaagcatcaataccgggtgtcttccaggtcctggcaggagaacatctctctgaaagagctccagagccgaggcgtgtgtttgctgaagctgcaggtatccagccagcgcactgggctgtacggacggctgctggtcacctttgagcccaggcgatacgggtccgcggcagctcttcccagtaacagctttacttctggtgtgtgcgtattgacctagacagacattgaaatttactggcattcagaccgtgacttgtaccctcgtaaagactggattaaaatgaccagttggagaataaagcgttgcaatgaagaactcttaatcagaagtccaacaattgatgtgggttttagttgtctagatcagcgttgtccaaaatggtagccattagccatgcgtggtcatcaaatgtttgaagtgtggcttgtaattgccgcagatacagaatacacaccaaatttggaagattatgttaaaaaaacaattgggaatatcttgagtaatttttctgaatactgattacatgttgaaataatatttttcatatattgggttaaataaaaaatatcttattaaaataatttacccatttcttttctttttttttttttttttttgagacagagtttcgctcttattgcccagtctggagtgcagtggcatgatctcggctcactgcaacctccgcctccagggttcaagtgattctcctgcctcagcctcccgagtagctgggattagaggcatgcgccaccgtgcctggctaattttgtatttttagtagagacggggtttctccatgttgttcaggctggtctcgaactcccaacttcaggtgatccgcctgctttggcctcccaaagtgctgggattacaggtgtgagccagtgcacccagcctcttttaaatttcttaatatggctactataaaacttaaaactacacgtgactgggtgcctgtaatcctagcactttgggaggccgaggtgggtggatcacttgatctcaggagttcgagaccagcctgggcaacgtggcaaaaccccatctctgcaaaaaaatagaaaaattagccagatgtggtggtgtgtgcctgtagttcctgctacttgatgggctgaggcaggaggatcgcttgaacctgggaggttgaggctgcagtgagctgaaatcacgccactgcactctagcttgggggcaaagtgagaccctctctcaaaacagacaaaaacaaaagaaaaactacatgtgactctctttatgtctctatgtaatgggcagccttggtccagctggtaaacatgcaggatgtgtacttctgtattcccaaccctttcttgtgccaagcatgctttggctaaacttgtgccagcctggttggaaaggagggacagttagaagaagcttcttaaccacacgcctgggatgcttgtgttagacaaccacagccttggaagcctggaggaagcagcgttgccagggctgtactttttactatggaagtgtctctgccttgttttggtggtgacggagttttaaatttcatattttgatttcgtagactttagcccaacaattactggaatactggctggatttggagaagatgagatgagggtattgagagaggagagggccaggaggggaacctgtaggttggagtcagacctgagcagagtttgagattttttttttctgagatggagtctcactctgtcgctcaggccggagtgcagtggtgcaatcttggctcactgcagcctcagcctcccgagtagctgggaccacaggtgcccgccaccacgcctggctaattttttgtatttttagtagagacgggctttcactgtgttagccaggatggtctcaatctcctgacctcgtgatctgcccacctctgcctcccaaagtactgggattacaggcgtgagccaccgtgcccggcctaacttactttcttttttttttttttaactgttactgattgcatttactaaagaaagtaacaaagataaaatatttgaagtatagtggattttattacagaaaatgatattgaagctttccccagtgtcttgtgtcactgagtctttgtttttgcaggtgatatcgtgggcctgtacgatgctgctaatgagggcagtcagctggccactgggatcttgacccgggtcacccagaagtcggtcacggtggcctttgatgagtcccacgatttccagttgagcttggaccgagagaattcctacagactgttaaaacttgccaatgatgtcacttacaggcgactgaaaaagtaagtggatgggactggaaatcctaagtaccatcttccttcaacacagctaatccattcttacatgcctgtcgcacaaaagagagcaacaagtcatggtgtgggtgtggccctcatgggagttggtggcagcattggggcagaggctcgggcactgaattgcaggtgttctaattttagttttctcccttggcagagccctgattgctctaaagaagtatcattctggcccagcctcctcactcatagaagtgctctttggcagatctgctcccagtcctgccagtgaaatacgtaagaacttctgagttttcttttttggttgaaatcactactgaaagtatagagaacagtgtgaccttgggccgttttaataagagtttgagaaagtatgactagaagaagtctccctgaacatctttgtaggagtgtctcggagggccttgcatgaactggaccgtcctccttgtactcagtcctaatgaactggctcgttccattgaggttttttttttttttttgagacagaatcttgctctgttgcccaggctggagtgcagtggcgcgatctcagctcattgcaaactccgcctcccgggttcaagtgattcttttgcctcaacctcccaagtagctgggactacaggcatgcaccaccacgcctggctaatttctgtacttttagtagagatgaggtttcaccatattgaccaggctggtctcgaactcctgacctcatgatccacccgccttggcctcccaaagtgctgggattacaggcgtgagccaccgtgcgcctggccccattgagtttttagttaaaaaaatttttttttggcggggggggtggggggggggcggatggagtctcgctctgtcacccagactggagtatagtggcatgatcttggctcactgcaacctccgcctcccgggctcaagtgattctcatgcctcagcctcctgaatagctgggattacaggcacacgccaccacgcctggctaatttttgtatttttagtggagacagggttttgccatcttggccaggctgttctcaaactcctgatctcaagtgatctactcacctcagcctcccaaagtgttgggattacaggcatgagctaccgtgcctagcctccattgagttttaaaataatgttctttttagtgtatataaatcttttattttgaaatgtaatgatatttcttttagcttagtactttgtgaaaatagaggaaagctgatcatactttatgcttgatagcaattttaggttggaaaaatcttttttttttttttttgagacggagacttgctctgtcaccaagagtggggtgcagtggtgcgacctcggctcactgcaacctccgcctcctgggttcaagtgactctcctgcctcagcctcccaagtagttgggattacaggtgcccgccaccatgcccggctaatttttgtattttttagtagagacaacatggtttcaccatgttggtcgggccggtcttgaactcctgacctcaggtgatctacctgcctcggcctcccaaagtgctgggattacaggcgtgagccaccgtgcccggtctgtgcactttttatgtcctttgctgttcttggagaacgtcatttttgggaggagtttgttgtctcatccagtcactgcccatgatttaacagtcctgtgagtattggacttggcccatttgtaaagcggtggctttggccaagcctcatgcaagggttaccccacagctattttctatcatactgtgctaggcaagccagtgttgtgttagcttcaaacacacaggacgactttgtagcactctttcagcatgcagtccctcaagatgtgttgtttttaaatactcattttctttctgcattttcctttggaaattctaaatgcagtcacatttcagtaatgctttatttctatgaaatatttactgaagggctcctatgcgtcacaaactgaattagaaatgtatttactgtgtcttagggactctggaatggcttggctagagcacgggaacgtggggttcaatggcctgttactagctgcacaccctgccgtcttccatgttggcttcagtctcacaagtcagggtcagcaaacaccctttgcttatgagctgctccttatccgataggcgtctctgtgtagtgggcaccatgtagcgaatgccatggctgcagggctgagcacagcaccacctgctctcaagagcacagcataagaagcaggtcttggccaggcgcggtggctcacacctttagtcccagcactttgggaggctgaggccggcagatcatgaggtcaggagatcaagaccatcctggccaacacggtgaatccccgtctctactaacaacacaaaaaattagctgggcatggtggcactcacctgtagtcccagctactctggaggctgaggcaggagaatcgcttgaacccaggaggcggatgttgcagtgagctgagatcatgccattgcactccagcctgggtgacaagcaagactccatctcaaaaaaaaaaaaaaaagaagcagatctttagtcttggtcgtggaagattcaaaatagaaacacgatcctagaatttgttaatcattgtttttgtcatttgtctttatcattttatgggcactttaaagagggacattatgttagaaaggaatatgctctaggaaacatttccttcattcctgttactctaaagcaggggtttttcctgtaaagggatggattgtgaatgttttgactctgtgggccatatcatacgtaccgtctacagctgcctgctgtagatggtatgtaaatcaatgggtgtggctgtgctccagtaaaactcaccaaaaccggcagctgactggatgtggcccacagtttgcctattcctgttcaaggagaaaccttgtgaaaataaagcagacttaattttgtgttgattgggttgcccctggggaggtccggcgtgttcctgacaggcatcactcatcccccggggcacacactctctgaggaggaacacccacagagctccccagagcacctgagcctcacgctgctgcttcttccacagacccgctgacattcttcaacacctgcctggacacctcccagaaagaagcggtttcatttgcgctgtctcagaaagaacttgccatcatccatggacctcctggcactgggaaaaccacgactgtggttgagatcattcttcaagctgtgaaacaaggcttaaaggtgggcagtgcatgccacttccctgtcagagcccgtccgctcctggtctgttgtgttcagtgggtgctcagcgacctttcagcctcagttctggtgggatgggtcaggaacattactgagcatttattgattgagccttggactgcccctgtttgatttccagcatccccgtgagtcttggggagcacgcgcaggagccgtagcctgggttgttgaggaaggctcctggagccctttgaggcgtggcagccttcgtgtcggccaggccctgggtcagggtttatttgttcaccacgcttgctgtgctcgtgctcctccgtgtgcacgcccgtgcaggggcctggagttggcctgggcccggtctgtgcccgtcaggagctcagcgtctggttgaggtgttaacagctaatcagatagtctggttaatggatacgatgcacatgtccagtgcacagatgaatgattttctgagatgtggaatataacattgtacattattattcacttacattttaaattttttttatttttattttttggagacggagcctcactctgtcacccaggctagagtctggagtgcaggggcgggatcttggctccctgcaacctccgcctcccgggtttaagtgattctcctacctcagcctcccgaacagctgggattataggcgtgcgccaccatgcctggctaatttttgtatttttagtagagatggagtttcaccacattggccagtctggtctcactcctgacttcagttgatctgcctgcctcagcctcccaaagtgctactattacaggcatgagccactgtgcccggcccagttacatttttaatggctgaaaaaggatcttttatcatcatctgcatcagcttgagtcattgtggatcttggcacatggagagttttttttttttaatttatttatttatttttaattatactttaagttctagagctttttgaaaaaactttctggtttataaaaatgttggataatgatgagaattggaataatggccagttttgtagtttgatgtttactgggtgctgcctaccaccaggcatcgttctgagcacccatttaatcctcactgaaaccctgtgccaaggcaggtggttagtggccccagtttgtagacaaggaagccgggtgtggtggctcacacctgtattctcagtactttgggaggctgaggcgggtgggtcacctgaggtcaggagttcgagaccagcctggctaacatggtgaaaccccgtctctactaaaaatacaaaacaattagccgggtgtggtggcacacacctgcaatcccagctacttgggaggctgaggcaggagaattgcttgaacctgggaggtggaggttgcagtgaaccgagatcgcaccattgcactccagcctgggcaataagagcaaaactccatctccaaaaaaaaaaaaaaaaaaaaaaaaaaaaaaaaccaaaaaaaccacgaggaaactgagaaacaaggtcaaatgcccagcactcagagtggcagagccagcaatggaactcgggcagagcgcagggaagcctgtcacttgcttaaaagattacgtccagcggttttccaatgtgtgagtgtctttgcacatgtttgaaaactggtaagaaaagatgacttattggaagggagcagattggtggttttaattgggtgccgactattcactaaaagtgagccaagacacacctgtgtgcacgctttggtggagatatgcctttggacatgccagtggggttggaggcgatgctgggcatagagagtgggtggctgagcctccttcctgagctgctgtttgttttgagcttaagggcctgtaaagactctgcctcctctgctggttgccacctcctcttttttttttcctcagagatggggtctcactatgttgtccagggtggtcttaaactcctgacctcgcaccttggcctcccaaagtgctgggattacaggcatgagccaccgtacttggccagcgtctcacttttaatagtggagctgtggctgggtgcagcggctcatgtctgttatcctagcgctttgggaggccaaggggggaggatcacttgaacccaggagtttgaggtcagtctgggcaacatagcaagacccagtctctacaaaaaatagaagaaattagctgggcatggtgatgcatgcctgcagtctcagctacttgggaggctgagccaggaagatagcttgagcccagaaagtcacgaaacaccaggagtgtggtctaggtcttgctgctcgccacacagaaagccagttactgaggacaagtattgccaaggaagaggctttataatcagatggtgcagccgaggagatgagagctcatcctcaaacccatctccctgactaaaactaggggtttatataacagggaagaaatgtagcaatgtgtaaaaaacaggaactagggagggcaaggaggcacctgtagtggtctggtgattttcagatctttgatatttttttgagaggcctcaatgtccttttctgaggaagaaactcacataaataagtttgaagctttaacagcaggtggtcaatttctctttatccaaaaacaactgtccatgggactattgagccggtttctccatgatcctgccactgcgctccagcctgggccatagagcaatttgtttcaaaaaaaaagaaagaaagaaagaaaaatatagtggagctacagtgttcgggagacaactgtgagtccatttgaaacgggaagggttcccttgtccccctcgcagggcgtgggatgggggagtggctcgcttcttcagtgtcctgctgctcagacctgcaggggagcatacagatgggcaggctgtgggctctgacctcatggcagtgtctaggggtgaatgtttacagctctgtgagttacagggtgctctcttagtttgccgtctataggtggcttatgttaaccaactcaattagatccccttccttgtcacaaggacagagggctttctgtatcctgggttcttgccttggggtaccggaagaatcggatcacacgtgggcttggaaaatgaatgcaagatttgattgagagcacgtgtgtacatgccttgtgcttctttctacctttaaggctttttgttgttttagtgtcaacttcagtggtttgattacaaagtaaatgaccagatcctaacttgcggttcccaggttctgtgctgcgccccctccaacatcgccgtggacaatctggtggagcgcctggctctgtgtaagcagcggattttgcgcctgggacaccctgcccgcctcctggagtccattcagcagcactccctggatgcggttttagcgcggagcgacagtgcccagattgttgcagatatcaggaaggacatcgaccaggtttttgtaggtgtcatggccagtgtccatgtggggggtggggttttgatttgcagtttttttaaggagcaaatttatttgtttgcattcctcttgacctttttttgcttctgtcgattcctttaataattttaaaaattgggctgcccttttttttttttttttttttttttttttttttttttttttttttttttttctttgtgacagagttttgctctcattgctcaggctgcagtgcagtggcgcaatctcggctcactgcaacctctgcctcctgggttcaagcgattctcctgcctcagcctccctagtagctgggactgcaggtgcgtgtcaccacgcctggctaatttttctatttttagttgagacagggtttcatcatactggtcaggctggtcttgaattcctgacctcaggtgctctgcccgcctcggcctctcaaagtgctgggattacaggcgtgagccaccatgcctggcctttgtttttgtttttttttttgagatggagtctcgctctgtcacccaggccggagtgtagtgctgctgtcttggctcactgcaggctccgcctcccggggtcaagtgattcttgtgcctcaccctcccaagtagctaggactacaggcatgtgccaccacacccaaccaatttttttatttttagtagagacgggggtttcgccatgtgggccaggctggtctcgaactcctaacctcaagtgatccacccgcctcagcctcccaaagtgctggattacaggtgtgagctactgtacccagccagggctgcccatttttgatagagaactatacttagcatttaacagagtctcaactgtcttcagagcacttggttagtaggtgtgaggaattgtaaagaaaacattttcccggcccggatacnagtggctcaacacgtgcaatcccagcactttgggaggccgaggtgggcggaacagttgaggtcaggagttcgagaccagcctggcccacatggtgaaaccccgtctctactaaaaatacaaaaattagctgagcatggtggcgggcacctgtaatcccagccacttgggaggctgaggcaggagaatctcttgaacctgggaggttggaggttgcagtgagccatggtcactccactgcactccagcctcggtgacaaagcaagactccgtctcaaaaaaaaaaccaaacattttcctgggtgtctttctgtctggtcctgttgtcttgctagtagtggcaatgggagaaaagtagcctgaacataaacattgaaaaaattggcatcctcctagagctttccgtccattccaccttctccttgtgaaagaggacaccagtcggctggagaagtagggtggtggtaggtttcttccatttgagagggccttttccccccagcccgacactccgacacttttgagctctttggttctcccgtggacgctttgttgtagtgtctgtgctcacgtcctgtcctgtgtgctcactgtcggtactggtactccttggtgtcttagtctcagaggagtgatggcagcagggagggtgctggagccagtctttgctctaatgtctgtgctcacatcttgtcctgtgtgcttacggtcagcacctgcaccctcggtgtcctaacctcggaagagtggcggcagcagagaaggtgctgggagccagtctttgctatgggcccgtggcatcgaggctgcttgcgtggctgcttgcatggcagcgtggggatgggccgcctgctgggagggggaggaaggatagatgcatgtcatgcaggttcgaggtggtggaggaatatgcatgatgtttgctcatcacaaatgtgggtgatttcatttcctgttgaaattggtgcttttgaggattttctttctctgtaaattatacacagtaaaatacctcctgtcacccctgctaaaactccatcccccaaagtagaaatcacaaataaggaaaggttacatcttttttttttttttttttttttttttttaaagaatcttgctctgtcgcccaggctggagtgcagtggtgcaatctcggctcactgcaacctccgcctcctgggttcaagcaattctcctgcctcagcctcccgagtagctgggattacaggcacacaccatgcccagctaattttttgtatttttagtagagacagcgtttcactgtgttggccaggctggtctcgatttcctgagctcgtgatctgcctgcctcgggctcccaaagtgctgggattacaggcatgagccaccgcgcctgaccagttccatctttttgagatattaaagtaagttgaggttttgattatgggttgaaaaaattttttttaatctcttgaaaaatgtagaataatatgtgaagctcagtctctccattcgtaagctcctacaacccaaatcctggggcgggcaagcgctttttcttccccaagatcaaatgcctgtgtgcagggcagggctggtccaatttctggtctcctctgagttaaaaacgtggtctctttccaggacttaaaatgtctcttcctgtgacttcaaggcaagtgaggatgtaaggtgcttagttgcgtgtgtgtatctgtgtctctttcaaggaagatttctgagtgttttttacggagtttattgaactggactgaatgatagaagcacttcataaatagagttgaagaagtacaaagttggactgaagtaagtgtatctcctttgtttttctttataggtgaaaaacaaaaagacccaggataagagagagaaaagtaattttcgaaatgaaattaagctgttaagaaaagaactgaaggagagggaagaagcagctatgctcgagagcctcacttcggcaaacgtggtccttgcaacaaacacaggtgagggggcgtctccatcctgcctgtgtggcctcgaagaaggagttggggtgtgttccctcttctgttttctggaagagtttgtttagaattggtatttctttcttaaaagttgggtagggttcactagggaaggcctccgtacctgcagttttcttcatggagaggttttgaactacaaattcaacttcttcaatagataaagggctgttcaggttgtttttcttccatgagcttgtagctttcaagaagtttgtccattttatctaaacggttgaatttagaggcatgaagtggttcctaatatgcccttattcttcttttactgtctgcaggatctgtcatgatataacctgtattattcctgatactggtttgtgtgctcttttttttcctgctcttctggctggagggttttttttttaaaatttagattttatatatacatacatatatattttaagagacagggtctctgccaggcgcagtggctcacacctgtaatcccagcattttgggatgccaatgcgggtggatcacctgaggtcaggagtttgagacctgcctagccaacatggtgaaaccccatctctactaaaaatacaaaaattagccaggagttgtggtatgcacctgtaattccagctacttgggaggctgaggtaggagaattgcttgaatcctggaggtggaggttgcagtgaaccaagatcgcgccactgcactccagcctgggtgacagagcaagactccgcctcaaaaaaataaaaaccccaaaaccaaaaaaacaaagcaaaacaaaaaaagagacagggtctcactatgttgcccaggctggtctcaaactcctgggctcaagggatccccctgcctcagcctcctaaagtgctaggattacaggtggacccaccgcgcccggcctggctggaggtttcaattgatcttcccaaagaaccagcttttgctttttctctattgtttttctgtttcatgtatttccacattgatctttatcgttttctgttttcttgggcttgttctttttcttgcttcttaatgtagaagctgagatcattgatttgagacctttctttttttctgatacgagcatttagctccataaatgtctccctaagtactgcttttgtggcatcccacaaattctgatctgttatatttcattcatttcaaaatgctatctcatttgccttttggttttttagaagtgttatatagtttctagatagttgggaaatgtccagatatctttctgttgttgatctctcctctcctctcccctcccctccccgtccccgtccccgtccccgtcctgtgtgggatctcactgtgttgctcctctcctctcctctcttcttctctcctctcctcatccctgtccccatccccatccccgtcgccttccctatccccatccccatatgggatctcactatgttgcccaggctggactcaaactcctgggctcaggtgattctcccagctcagcctcctgaggagctggggctccctgcatgtgccactgcacctggcttactttctgttattggtttctaatttagttccatgtggtcagaggacatactctcatgacttggatagttcatcgagacttactttatggtccagaatctggtctctgtctttgtgagtgttccatgcacacttgatagaacgtgtgttctgattttattgagtgttctgtaagtagtcagatcatgatggttgatgatgtggttcaagtctgctgtattgagagagggacgttgaaatctctgaatataactggacatgtctgtttttcctgcagttctattggtttttgcttcatatctttggaaactcttttactggggtcataaatgtggggctatgttttcttgattaattaacaaatttatcattatgaaatgaccttctttatccctgataatattctttttttgaaatctactttgtctgacattaaaataatcatttcagcatttcagcttgcttttcttttcattatggtcaaaaacctgtaaaatttaccatcgtaaccctttttaagtctgtagtacagtagcattaattgtatgcatgttgttgtacagcagatctctagaacattttcatcttgcagacctgaagctctggatctgttgaacagcaattccctttttccctgtcccagatcctggcagtcaccattctcctgtctgtttctaagaattttattattttacatacctcaagtaagtggaaccatgcaggatttgtcgtcttgtgactggcttgttttatttagtgtaatgccctcatggttcatccatgttgtccagctttctttttatttttaagagacagggtcccaatctgtcacctaggctggagtacagtggtgcggtcaaagctgtactccagccttaaccatgaatgtgggacctccagcaatcctcccacattgacctcctgagttgctgggattaacaggcgtgagccattgcacccagcccccacctttctttcaactagtgttagtgtgatctatctttatcctttttcttagaacctatttgtgtctttatgtttaaagtgatcttttaaaaaatatttgagacacggtctcactgtgttacccctaactggagttgcagtggtgcaatcatggctccctgcagcctcaacctcctgggctgaagtgattctcccacctcagcctcctgagtagctgggacaacagacacgtgctatcacaccctgctcatttttttgatttttaatagagacaagatctcactgtgttgcccaggctggtctggagttcctggactcaagtagtccttccacctctgcctcccacagtgctaggattacaagtgtaagccactgtgcctggcctgtttatttctttttaaagagagagtcttgctctgttgctcagactggagtgcagaggcgtgatcataacttgctgtagccttgcattctttggctcaagtaatcctcccacctcagcttcccgagtagctagtactgtaggcatgagccattacacctggctaattttaaaaatgttcttttcttttttccttttagagatggggtcttgcaatgttgcccaggctggtctcaaactcctggcctcaagtgatcctcccactttggcctaaagtgaatttttttgtagatagcatatagctgggccttgctttattatccagtttgacagtttctgccgtttgttctttgttatattttcctcctcttctgctttcttttaattaattaattgaacatttcttttttttttttacataagttctcactatgccccatgattgaagatttcttaggaatttatttttatttatttatttatttttaaaagataatttatagagacaaggtcttgctgttttgcccaggctggtctcgaactcctggactcaggggatcctcccaccttggccaccttggtgctgggattataggcatgaaccatcactcctggcctatttttgtttttgttggcttgttagctatatatctgtatttgattctttcagtggttactttaggccttacagtatgtgtcttcaactcatcatagtctgttcatatgccacctcacatatagcataagggctttatgattgcaagctgacatttctctcctcttagcatttatgcttttgtcatatatttttcttatacgcatattctaagacttacaatgcttgttcttgttttaatggtgaattatctttaaagagatctaaataataagaaaaatgtcttcgtatttgcccgtgtagttaccacttttggcgctttgttttcttttggtttaggtcgtgtatttccacgtggcatcattttccttccacctgaaaggcatccatgatcatttcttgtagtgtgggtcagccggtgatgcagtccaatagcttttgtatgtctgaaaatatcttgtttcacctgcagttttgaaagatatttttgctgcgtgagaattctagattaacacttttccttgcaatattttaaagatgttgtccactgtcatctgcctgagtatttctgaagagaaattggtcatccttatccttgttcctttgtatgtaacgtgtcttttttcttctgtctgcatttaagattttttcagccaggtgtggtggctcatgcctgtaatctcagcactttgggaggcttaaggcgagtggatcacctgaggtcaggagtccgagaccagcctggcccacatgtactaaaaatacaaaaaaattagcagggtgtggtggtgggcacctgtaatcccagatgctcaggaggctgaggcaggagactcgcttgaacccggaggcggagattgcagtgagctgagattgcaccactgtactccaacctggacgacagagccagactccgtctcaaaaaaaaaaagaaagaaaatgatgctttctttatcactggttttaagcaatttgactatgatttgccctggtgctatttgcttcatgtttttttttcagacagagtctcatctgatcgtgcccacacacgccgaagctaacatcgtgc

SEQ ID NO: 21 - DNA, 17866 bp, Homo sapiens
  unsure (6788): Identity of nucleotide sequences at the above locations are unknown.
cgtggttgaagacagtagtatctcccatgtgaaaggcacagtcacctgtcacagggtgcacatggggtgcattaggcttgatttgtactctgcagactatgggggaagctgaggaggaagacttgaccagtcttggtgatgagaaggccttcaccctatgaacacaaccaagtcttagccctctctcctgctcctttaaactctgaactctaggatgggagaatgggaacttttgcaggttgagattcatagtgaaatcgggtcaagaagtgatcagatgcaaagcacagggcagttcattactataccatggctgaggtcttcctgggcaccaggccctggtctcagcacttggctcagtctgcaccttggaccctgccagagccctccacagcaggtgctctcaggcaaggctgtgtgttgctggccagacgccttctgaccagcgtgctttcttgaccacagatcccttggccaagcaggagggaaccattagcagcctgaggagctggctggctgggagcctcggggaccgcccagccttgctcccagctcacccacaagatgtggacagctcttgtgctcatttggattttctccttgtccttatctgaaagccatgcggcatccaacgatccacgtaagtgagaaagctgtgtgactgctggatgggcccacggtggccacaaagcatgctgagcccttgaaagcagcatctgcaaacccaggccaacgcgtcaggaaccgcagccctcccaggtgccgcacagggaagggttgtcaggccaaccttccttctccagggccatggtgggcaaagagcccctagcaggaccaggcagctgagccctgaaaggtttgctcgcttggcctgcaagatttgatgtcatctctaaattgaatcttcactggggaattgattccttcatacatcagatctttaactgcgttcccactctgtgccattcatttccaagaattcctgcagtgaatcctttcacaaagccaagcgttcttttatgatgtgaatacctgtgcagtttatctgctttgtaaacctgggtgtgcgttcagtgggcttttaatggtgaatcacacctgttgtgtgagacttttactctgatgttttgggaattggatcaaatagtgaaggtctgaagccttcaatgggcagggggttcatagagggcaaaggagttttaaaatcaaattgacaagggctttttcaatgagctgcatgccaacagtgggaagagagatggggaggaagcatgttcgcacatcacctcccccgactctggctgggctgaggagggggccccacaggcctgggtggaagccgatccctgagcaatccccctgtgcaggattgaacatgattgtctctctttttctcctttttctgactttaaggcaactttgtccctaacaaaatgtggaagggattagtcaagaggaatgcatctgtggaaacagttgataataaaacgtctgaggatgtaaccatggcagcagcttctcctgtcacattgaccaaagggacttcggcagcccacctcaactctatggaagtcacaacagaggacacaagcaggacagatgtgagtgaaccagcaacttcaggagttgcagctgatggtgtgacctccattgctcccacggctgtggcctccagtacgactgcggcctccattacgactgcggcctccagtatgactgtggcctccagtgctcccacgactgcagcctccagtacaactgtggcctccattgctcccacgactgcagcctccagtatgactgcggcctccagcactcccatgacacttgcactccccgcgcccacgtccacttccacagggcggaccccgtccactaccgccactgggcatccatctctcagcacagccctcgcacaagtgccaaagagcagcgcgttgccaagaacagcaaccctggccacattggccacacgtgctcagactgtagcgaccacagcaaacacaagcagccccatgagcactcgtccaagtccttccaagcacatgcccagtgacaccgcggcaagccctgtaccccctatgcgtccccaagcacaaggtcccattagccaggtgtcagtggaccagcctgtggttaacacaacaaataaatccacacccatgccctcaaacacaaccccagagcccgcccccacccccacagtggtgaccaccaccaaggcacaagccagggagccaactgccagcccagtgccagtacctcacaccagcccaatccctgagatggaggccatgtcccccacgacacagccaagccccatgccatatacccagagggccgctgggccaggcacatcccaggcaccggagcaggtagagactgaagccacaccaggtactgattccactgggccaacacccaggagctcagggggcactaagatgccagccacggactcgtgccagcccagcacccaaggccagtacatggtggtcaccactgagcccctcacccaggccgtggtagacaaaactctccttctggtggtgctgttactcggggtgacccttttcatcacagtcttggttttgtttgccctgcaggcctatgagagctacaagaagaaggactacacccaggtggactacttaatcaacgggatgtatgcggactcagaaatgtgaggggggcgggggcctggcgggaggcctggccccttcctcgtcctttccttttgcctttgagaccaaaccaagtgcttccaaattcttttggtgcaattgaggagatatgccagatgcttaaacacatttaattgctgtcagattaattccatgatcactaaagagttgctgcttttttcatatttatttttgtaaatgattctgtgcccaggagcagctgggggttccacctcagggtggggcgggcaggaccccgtctccccaggtgtcggagcctgacctgaattaaagtactgactgctcgccacaatcgtgtgggtgcatcctgctccttggggagccttgctttctgccgtgcacgtggcagggttttgttctgtgaatgtgcaccatcactccgcaccctggaggttgactgtgtcgttgccactgacttgggtttctccctggtacccacgcccgccctggtgcttgctgggaggctcctgggccccagaggaggccacagccagcatctttaatcctttttctgacctgttcgatgaacctcctggagccagccttaggggtgaaggagctaaattcaacacatcacccccgtggtgtggccagctcggcctgaacctgcgcagaacagaatctgatcctgccctgctcatgaggtggggtcactattgctagtcctgaatagtgcaagtcccttgctccaggtaacccaggaccccagggccagtcctgggattcgaccccggagcctgctccttaggccagttcccctggattccaggctcccatcctgaacatccagccagcacttgctctgtgcttgttacatgcctgccctgtccctgtgctgtgtgaatgtgacttgctgtgtgagtgtaacctgctgtgtatgacctgctgtgtgagtgtaacctactgtgtgtaacctgtgtgtgacccgctgcgtgtgtgtgatctgtgcgtgtgtaatgtgctgtgcatgtgtaacttgctgcgtgagtgcaacccactgtgtgtgtgtaacctgctgcacatgtgtgacctgctgcattgcctcagccccaggagatcagcatcacaatctccattttgaagacgggaccactgaggcacagagcaaagtcactcctggaggcccagagtcaggattgagccctggtcctagagtcccagctgtttgtttaactaggttcctttgccacctgcccagcctgagcttggcctttggtccttcatctgcccacctgcccaaggcagcaagagctgatgggccacacgtggccagggcatcttgtaaggccatgttctcaggccaggtctgcggctgctgagacctggagcaagctatagagtgttctggagctcggcttcttcctctgggaaatggggagagacagagcagcatctgctgtaaacatggcagcatggggccccacccaaaagtggttgtggagttggctgtggcttctcaaccacctggcgctgaggcagagctgatctttgtccggaatctcctgtctcccactcaccaagatctccctgggctaggtttgggtggccagcttcttatttaagttcatctccaaaaaggatgtcaaagggcctgggataaaaggctaagacggtaactcccaaaccatttgaagtaacttcaaagccgaggctgggaaaatatggagtggggagaatgggtcagaagctgccccccagtcctctcctcctgtcttctccctcactgcaccccggcttccccagccttttctttctcattgtcacgtcctgctggccccttcccctctcccagccttcactgcctgagtcaggccttctggactgacagccacactccacagagcttgtgcctgactgtctcctttcctggccatcacacatcggagtcgcatctgcatgcttaactacaggcactggcgctggctgggaaggtggttggttccagcccctggcttgtctcccttgccatcttgagctctaggccagctcgcagcattgtccttgaatctgacaagacaccgtctgcccggaatgggcagctctgcccaccatgggtagacaatcggagctgtggaggatgccctttcctctgcctgacttcaccccagtggcccaggcgaggaccagcctgctaagggtcagctctccaccctggctcattgagcctcccctgggagagccagaaccctgggcctgtgtgagctgtggcttggggggtgttctcatagactgtgggcacctcgttcctttctggggaggtaggatgaagagtaacctgcagtgctggccttcagcttgtgactaacggcctctgcctggcacccctacatccagggagtgggccacagggatctgcagagtcagccagtcagtccccctgccccagccagggcccccaatttttttttgacagaatctcactctgtcacccaggctggagtgcagtgacacgatctcggctgagtgcagcctctacctcctgggttcaaacgattctcctgcttcagcctcccgagtagctgggattacaggtgcatgccaccatgcctggctaatttttgtatttttagtagagatgggattttgccatgttggccaggctgctctcaaactcctgatctcaagtgaaccaccctcctcggcctccactgggattccaggcatgagccatcgcacccagtctccgaattcttttatcctctgagagcattggtcacactctccccctccatccttgggggtcctattccaaaccccctgccattgttctctcttggatggcgttcctcctggaccacaggtgcctcaaactcagcatccaaggccaacctcagcatcggcccccaggagtgtgtttggccccaggggtcctccctgtacctaatggcatccccacgtgggctaacagatttagaaacctgtgcttccccctgagtccaactggccatcctaaaggtttcagtactccggccgcttcccctgtcctgaccccagctgctgcccggccttgggcccaccaccaactgcctgcccactctgctcccagacagcctggctcatccgttctccaccctgcggcaagggacccgtcaaaacacaaatctaaccacacccgtccctgccgaaagccccaagctcctctgcccagcactacaggcccaatgcagccccctgtggtgagtcccagccaaacagagctcaaggcgcccccgtcgcagacctgtccaaatccaggggctccgggctttcttctccctgccttggaggacacgagactgcaagataagccaggtgccatcctggcctacacaaagtcccattcaactcactttatcaggtgcctagtgagcacctactgtttgccagcccaatggggattcagagatgacgtggcccaggagcccccggtgcggtgggtgagacctgccttgtgaggaacacaatgaaggtgaggggtgggctcagagaaggtgcctcctccaccctggggagctcagagagctcagagcccccctcaggctttctgttcctgcggcaggggcagtggctcatccggggcctagcacagcactgacacacaggaggtacaaagtccctaactgatgggtgagagtccacacagaaggtgccagaaggccaaacagaagtgagagtccaattcggggcttggccccaaaaggagctctcgtcccttcacagtgaggaaaccaaggcacagaaaggccaggttgcttggccgaggtcatccaccaagcaaatggcagcacagcattcacactggatctgtctgcaaatgttgggcgtggctcaggagcacacgatggccacagggagcagaggctcctccaaagccgtgagagctgagcattcacaccggatctgtctgcaaatgttgggcgtggctgagcacaccacggccgtagggagcagaggctcctccaaagccttgagagccccggcagggcatggcctcgagctcgacagggcatggcctcgagccagccagtttctctaggagcagggccgcatctcttggtagaggaagtccaagggctccccctggcgggcaaggctccctcctanccttcttgttttttgtttttttgagacagagtttcattcttgttgcccaggctggagtgcatcttggctcactgcagcctctgcctcccgggtttaagcgattctcagcctcctgagtagctggcattataggcgcctgccactacgcccagctaagtttttgtattttactagagacggggtttcaccatgttggccagaccggtctggaactcctgacctcaaggtgatcctcctgcctcggcctcccaaagtgctgggattacaggtgtgagccaccacgtcctgcccctcccagcctatttcaccagccctggtgctggccttggctagagacaccatcccaccctccggccccctgcgcctaccattccatgtttgcaggtggaaaccccttagcccgctcccctgacagcagggagtcttgccgttaccccacaccagagaactctggccctctttgattgttccaggccaggggggctcggcttccactatgggatggattgttctaggtggtattaggtcatttgcgcctgtaactgtctcccaccagaaggaatccacgagttcagggagaatgcaatgaactcacaggcagccccccgggcctcggtcccaaaacccaccagctgggtcagttgggacaaaccacgaccatactcagccacaatttccgtatctacagctttgcttcaagatccagcgcagtggctgacacaagccgatactttttagaatatggactacgttcgactacgttgaattctctgtgatggtcttcctgctccccgccccagccctactcatcctccacacagcagccggaggatattttaaaaacacaactcagctcctaatactcccctgcacagcaatccccgatggcctcctgctgtgagcaggaaacaaaatccaaacatttgcagtaaaaacacagatgaaaaatcagggagatgcgggatccaggcagagaggccagcaatgcggagcccccaggacagatccaaggccacaagtgtgaggagagaagggccctggggagagtgaaagagacaggccggtcccaggggacagcggcgggggaggagcgggagagcccaggaatgcacagggagtcacgttatccagttcagagtttaaaagatgactctgttgcttgaggctgaagtcataggctgtctgaggtgtgctttaaaatgcttccacatcaggagaagggggcaagagaatcgtgccacaagacacatgtggctgccatccatccagcatggctgatggcttcatggaagtggggggtctgtttcccactctctccatgtttgtgtgtgtttagaaatttccatcatcaaaagttaaaagaggccaggcttggtggctcatgcctgtcatcccagcactttgggaggccgagttgagtggatcatttgaggtcaggagtttgagaccagcctggccaacatggcaaaaccccatctctactaaaaatccaaaaattagctgggtgtggtggcaggtaggtgcctgtaatcccagctactcaggaggctgaggcaggagaatttcttgaacccaggaggtggaggttgcagtgagccgagattgcgccaccgcactccagcctgggtgatagagtgagactccgtctcaaaaaacccaaaagttaaaagaaaaagtgaatggaagggagggaggaggggaggaagagtttcaacttctatctcataagtacacgatcactttggctgcagatagagaggcctggctggctcggtcatccgcggagtgaggaggctggcttggaccagggtgtgttcacacagatggacagaaaccgaggaccctaggggccactttggaggctgagtcagcaggacgtgcactgcttccttatgtacgatccacgtgcccacggcaggagccggggtgacccctgcatttttggtttgagaaggtggaatggtggagggatcgtttcttggggggagggaaagggtgaacctttattcccagtgcttcacacgtgaattcatttcatcctcaccacagccctgcgagatagtatgtcatcatcatcagccccccgtttagaggggaaactaaggcctggggaattcatgaacctgcccaccgttacacatgtcacattgctggtaggtgaccccagcttctatgcttttaccactagaccatactgcctcttttttttgtttgtttgagacagagtctcactttgtcacccaggctagaatgcagtgtcataatcttggctcactgcaacctctgcctcctgggatcaagcaattctcctgcctcagcctccagagtagctgagaccacaggcgcctgccaccatgcccccttaatttttgtatttttagtagagacagggtttcaccatgttggccaggctggcctcaaactcccgaccacaagtgatctgcccgcctcagcctcccaaagtgctgggattacaggtgtgagccactgtgcccggcctatactgtctcttgataagggggtacagaaggatttggagagaaggtggcccagaaatcaagagtcctgctgtgggttgtgaaggcagagatgcctattggatgccaggcagacactggccgtgagtctgaagcacagggaaggtccccacaggactggtagagtgcttcaccgcctccccacgtggcgggaaccatttctaagcccactttcagatgaggaaatagacaacaggggaggtaggtgacttgcccaaggtcacacacaaggtaaggggtgggcccagtccacctgactcctgaaccccaacttcaccagtgctgcgtgctccgggcacacgctgaatgtacttgaagcacaagatgagccccgctgggcaatctggacttcagagtgaaaaactcactgtcttttatgagccagggcccacggcaggggcctggtcccgctttgctgactgtagagatgcccgcttggacaggacacagcaggagggcagcaggcacgaagacgtcaggtgagcagagagaaccacggagtggcgccaggcgggtaggcccagcacatgagattccgggggccctatacgtggaaatgcatgaagaaggaagactccacctcagcctctggcctttctcctgaatctctgggagaccccccaactcagcatctgaaagatccagagaacaggtccacgaacacggagcagctctttgtcttggggagcctgtggctacaaggaacagaaacctcaggccgtcccaagacggggatttgctgcaaagacagaatgagagccgggcctcctgggggccgtgcgtctgctcctctccttccctctgctctctgcccatctctgctcctctctgcagaggacctacctcccgaagctgttaggctctgctttccccaaggggctctgattgtaaccttggctccaacagcagcccatttaagctgcctgtccaacgcccaggtcctctgtgatccagtccactgtagccacaaggctgtccctagtgggctgtcacagcccagctgttcagaaagggttgtgggccaggcgcagtggctcagcctgtaatcctagcactttggaggtgaggcagaggttagttcaagcccaggaattcaagaccagcctgggcaacatagcaagaccccatccctacaaaaaataaaaactagccaggcatggtggcacatgcctgtactcccagttcctcgggaggataaggcaggaggatggcttgagcccagcaggttgaggctgcagtgagctatgatcccaccactgcactctagcctgggtgacagagaagaccctgtctcaaaaaaaaggggaggatgtggacagagaaggaaggatgtgcatagcttgggatctgtgccaggccctgggctgagctctgggacacaaagatgcaaaggaaatgcttcctgccttccaggagttacagtggggaaatcagatggtgacagtgacaggcagtcaacagggacaggaaaaatggcgctctaaggccccactcgggagcttcactctgcagggcaattggcagtggcattaaagctaaagatgcagccgggtgcggtggctcacacctgtaatcccagcactttgggaggccgaggtgggcggatcacctgaggtcagtagtttgagaccagcctggccaacatggtgaaaccccatctctactaaaaacacaaaaaaatttagccgtgcatggtagcaggcatctatagtcccagctactctggagggtgaggcacaagcatcacttgaatccgggaggtggagcttgtagtgagccgagatcacaccactgcactccagcctgggtgacagaacaagactccgtctcaattaaaaacaaaacaaaacaaaaagactaaagatgcaatcacacatcttggtttcttccttatgaaagcacacatggaggcactaaggagaacatcatgggccacattatttgtgatggcaaaacattttaaagctccaaatcatcttcaatggtgcttatacaaagtactgaacaacagttcagaggaatgagctagagctccatgtaacagaattagtagttttcagccaggcacggtggctcacgcctataatcccagcactttgggaggccgaggtgggtggatcacctgaggttgggagttgaagaccagcctagctaacatggcaaaacttcgtctctactaaaaatacaaaaattagccgggcatggttgtgggcacctgtagtcccagctacttgggaggctgaggcaggagaatggcatgaacccgggaggcagagcttgcagtgagctgggatcacgccactgcactccagtctgggtgacagagcaagactccatctccaaaaaaaaaaaattagtagttttccaagacatactattgagcaaagaaaaagaaaagttgctgatagtaccgtacaatactgcttgcattagttacctattgcagtacaatattaccacaaatttagccattcaaaaaacagcccacagctgggcgtggtggctcacacctgtagtcccagcactttgggaggccgaggcaggcggatcacaaggtcaggagattgagaccatcctggctaacacagtgaaaccctgtctctactaaaaatacaaaaaaaattagccaggcatggtggcacgggcctgtagccccagctgctagggaggctgaggcaggagaattgcttgatcccaggaggtggaggttgcggtgaaccaagattgtgcccctgcactccagcctgggcaacagagcgagactccatatcaaaaacaaaacaaaaaaaccagcccacatttatcacctcagtttctgtgagccaggaatctgagcgaggcttagctgggtcttccaattcagggtctcacagagctttaatcaaggtgtcagcaagggctgcagtctcatctgaggctcacctggggaaggatctgcttctacgctcacatggttgttggtagcattcagttccttgcaggactgcagactgagggcttcagcttctcactggcttttggaggctggaggctgcacccacttccttgtcatgtggctcactccataggccgctcgtgacagggcagcttgcttcttcaaagccagcaaggcagagagtcactaagcaagacagactttataatcttttaaaattattagtgtgataaaatatacatcagataaaatttaccatttttaccattttaagtgtacaattcagtggcattaaatacattcacagtatttaattgtataaccagtactttttccaccatcccaaacagaagctctctacccattaagcaataactctctgcttcctccacccccagctcctggtaatctttattctactttctgtcttcataaatttgcctattctagatagagtggagtgatagaagtggaatcatccaatgtttgtcctttcacttctgattttagtaatctgagctttttttttggttagtttagctaaagatttgtccattctgttgatttttttttcaactttgatttcattatttaatggttaattttagctgtcaacttgactgagttaagggatatccagatagctgggaaagtgttatttctcggtgtgtctgtgagggtgcttctggaggttggcatctgaatcaccggactgaatgaggaagatctgtccacatccaatgtgggcaggcactgtattagtccgttctcacactgctaataaagacatacctgagactgggtaatttataaaggaaagaggcttaattgactcacagttcagcattgctggggaggcctcaggaaacttaccattatgggtcaggggaagcaaatacatccttcttcacttggcagcagcaggagaagaatgagagtccagcgaagggagaagccccttataaaaccatcagatctcataagaactaactcactatgatgagaacaggatgggggtaccacccccatgatccaattatctccatatggtccctcccatgacatgtgggtattatgggaactacagttcaagatgagatttgggtggggacacagccaaaccatatcagacaccatgcaacttgtttaggcccatatagaacaaaaaggcagaggaatggtgaattcactcttctggagctgggacatctgtcttctcttgctttggacatcagaattccaggttctcaggccttcagactctgggacttataccagtttcccaatttctcaggcctttggccttagtgagttacgctattggcttccctgattcaggcctttgaactcagaatgaattagatcacaacttccctcattccccagtttgcagacagcacattgtggaacttctcgtcttccataatcatgtcagtgaattcccatagtcaatctattatctatctatctatctatctatctatctacctatcatgtgtctgcgtatgtatctatctgtatatatgtatgtatgtagccatctatctatctttgtatctatctgtatgtatgtatgtttctatctatctttgcttctgttttttggagaaccctaatacacattgatttttttctttttcttctttttctagtccaagtgaagcagtgggagtaaagaaggaacaaagaggccgagcgtggtggctcacacctgtaatcccagcactttgggaggccaaggcgggtggatcacctgaggtcgggagttcgagactggcctgaccaacatggagaaaccccgtctctactaaaaatacaaaattagcctggcatggtggcgcatgcctgtaatcccagctacttgggaggctgaggcaggagaatcacttgaacctgggaggcagaggttgcaatgaactgagatcacgccactgcactccagcctgggcaacaagagcgaaattccatctcaaaaaaaaaaaaaaaaaaagaaggaacaaagaaatccataactgcatgttatcagttagtcgtaaacacccctgcactcaaacgaacctaatacgcactgattttatctgtcatttttctattctctatcttgtgtatctcagctctaatttttattattcttccttctgctagctttgggttttgtttgctcttctttttctagttctttaagacgtacagttaggttattgatttgagatctttcttcttttttaatatagacatttacaactataaatttcttttctagcagtgccttttttgtatcttttaagttttgatatgctgtggttttttgggtttgtttttgtttttgtttttgttttcatcttatagtctgttctcatgctgctgtaaagaactgcctgagactggataatttataaaggaacaaaatttaattgactcacagttctgcatggctggggatatctcaggaaacttatgatcatgggggaaggggaagcaaacacatccttcttcacatggcagcaggagagagaagtgcaagcaggggaaatgctagatgcttataaaactatcagatctcatgagactcactcactgtcataagaacagcatgggggaaactgcccccatgatctcattacctccacctgatcccccacccttgacacgtggggattcttataattcaaggtgagatttgggtggggacacggagccaatcacaacgtttgagttgtgatttattcttcaatccattgattaagagtgtactgttttggtagggtgtgttggctcacacctgtaatcccagcactttgggaggctgaggcaggcaaatcacctgaggtcaggagtttgagaccagcctggccaacatggtgaaactccatctctactgaaaaaatacaaaaattagctagatgtggtggcagtcacctgtaatttcagctacttgggaagctgaggcaggaaaatcgatctgggaggtgaaggttgtagtgagccgagatcccaccaccacactacagcctgggcaacacagtgaaactctgtctcaaaaataaaataaaataaaataaaagagtatattgtttaatttccatatatttgtgaattttctagttttccttctgttattgcattctagtttcattccactgtggttgtaaaagatattttatattatttcagtcttttaaaatttagtaagacctgttttttggcttaatgtatgatttgtcttgtagaatgttgcatgtctacttgagaagaatgtatattccacttttgttgattgagtatatatctgttaggtctaattgcttgaaaatataatttaagtcctctcttcttttttttttttttttttttgagacagacactcaggctggagtgcactggtgccatctcggctcactgcaacctctgcctcccgggttcaaacaattatcctgcctcagactcctgagtatctggaattacaggcatgcgccaccatgcccagctaatttttgtatttttagtagagacgggctttcaacatgttggtcaggctggtctcaaactcctgacctcatgatccacctgcttcagcctcccaaagttctgggattacaggcatgagccaccccacccggcttttttttttagatggagttttgctctatttcctaggctggagtgcagtggcacgatctcagctcactgcaacctccacctcctgggttcaagtgattctcctaccttaccctcctgagtagctgggattacaggtgcatgccaccacatgcagctaatttttgtatttttagtagagatgtgatttcgccatgttggccagactggtcttgaactcctgacttcaggtgatccacctgcctcggcctcccaaagtgctgggattacaggcatgagccaccacacccagccagtcctccatttctttattgatcttctgtctggccattctatccattattaaaagtgagatactaaaatttctattattgcagacatatctattttccccttcaattctgtccatttttgcttcatattttgggactttttttgttaggttcatatatgtttataattgttgtatcttgttgctgggttgaaatttttatgactatataatgttattcttttctctgatagcctttttctttttttacttatagtttaataaccacccttgctctcctttgcttactatttcacggtatatcttttttcacccttttactttcaatctctttgtgtctttgtttctaaagtgaatctccttagaaactgagaaggcagtagtaaaaaagaaaaaaaaaagataaagtgaatcttttaaagatggcattaggccaagcacagtggcttatacctgtaatcccagcactttgggagaccaaggcaggtggatcacttgaggtcaggagttcgagaccagcctggctatcatggtgaaaccttgtctctactaaaaatatagtagtggtggtgggagcctgtaatcccagctacttgggaggctaaggcagaattgcttgaacctgggaggctgagatagcagtgagctgagatgacaccactgcactccagcctggacacagagtgagactctgtctcaaaataaatacataaataaataaagacagcattagatcaagcttgtccaacccacggcctgtgggccacatgtggcccaggacatccttgaatgtggcccaatacaaatttgtaaactttcttaaaacattatgaggtttttttgtgatttttttgttttagctcatcagcttagtgttagtgtattttctgtgtggcccaagtcaattcttcttcttccaatgtggctcagggaagccaaaacattgaacacccctgatatagatggatcatgatttttaaaatccaacctgccaatttctaccttttaattggagagtttattacatttatatttaaagtaaatattgataaggaaggatttacttctccatgaagctatttgttttctgtgtcatatattttttgttcttcagttcctccattagtgccttttttgcatttattaatttttttgtagaaaacaattttgattcccttctttccttttctgaattttttagaagttattttgttggtggttaccttgagaattacaattaatatcttaaacttataacaacttagtttaaaaaataccaacttagtttcaaaagtatacacacactctgctcccacacattcctattcttccttccctttaaattgttattatcacaaattacatctttatccatagatttgtaattatgttttatgtacttgcttttcttttcttttccttttttttttttttgagatggaatctcgttctgtcacccaggttggagtgcagtggcacgatctcagctcactgcaaactccacctcctgggttcacaccattctcttgcctcagcctcccaagtagctgggactacaggcacgtgccaccacgcccagctaattttttgtgtttttcgtagagatggggtttcaccgtgttagccaggatggtctcgagctcctggctaacacgggtcttcaccacggggctggaaggtcccgcgcttagcgcta

SEQ ID NO: 22 - DNA, 19223 bp, Homo sapiens
gaagacaggcagtacacttaggacaaaaaggtgaaaaacacacaagctcttcagggacctgcagtccatgggagacacagaaaagaggtcattgcaggctggcacaagcattgtgcagggtgtgactcagtgctgggaagcaaggaggagacagtatgcgggcaggccttgaagagtgaggtaggctgatactctgggcagaagccccaagggtggctgggccccagaggacagggtgccacaggggcccagaggacacagttcagccagtggtggtgtggtcggcatgccaaggaaggcttcctgggaaagcgatgcctgggccgcattctgaaagctgggtgggggtgggcaggcaggtggagagggagcagcagatgacaacagcagggtcagaggcaaggaagagcatggtgaggcgggaattagtctggagagcgtgaggaggccccatgagccatgtggcagtttagatttcacagtagggggatgcgagtccctccggggccttagacaagaacagaaaggtgcttttagcaagaggggaggcaggggcagccagtgaggggcagcgatccaggcacctgatacagaggctctctcaatgaatgaaggcatgagtgaatgagtgactgacccacttcagaaactgcagtggtccccacagccggcccaagttgctgtaaagcaaagccctctccttcattctaatgctccacagaagtgatgtggacgccttaacacatttttatttttttgagatgggtctcgctctgctgcccaggctggactgcagtggcatgatcgtacctcactacagttttgacctcccaggctcaaatgatcctcccacctcagctgggatcacaggcgcatgccaccacacctggctattttttttgtgtgtgtggagagaggattcttgctatgttgcccagggtggtctccagctcctcggctgaagcaatcttcccaccttggcctccaaagtattgggattacaggcatgagctattgtgcccggcccttaatgtattataaaaaaattatttggtttggtttatttgttttgttagataaaataatgaaaacagtcacaaggtaaccagcacttagcagcccacagcaaagtgtggccccagctgcatagctgtaggcagactggggctttggggtgctgggtgagctgcccattggtcactcagggacgaaggggccattgaatgcatgagtggcagaagcagccttttagctctttcagcattcactgtcattcccttgaggaagctactgtaatagggtcaagagaccatgcaaggggagtgggagaccagcaggacacacagaggccaacagcactgcctgcgttccaactccagctcccatgctcactaaccaagtgacatgtgcagccacaggacctctgagccccgctgagctgcatgggagtgacatgggacatgggatcacacgggcaaggacccagcatggcgcctggcttagccagcagcccacccgagaagcacttccagctacgcaaaagcagccactgcgcaacaagaagcccctgggtggcttcctgcctcctgtaatccatgtggactgttgtcaagctgccccggggctggagaaagcccttagagcacacactcctctggaaggctggtgtgttccacgagacttccggtctctttccgagagtcactaacttttctctagcttcaaatggtgctttctcttcaaaatggtctgtaagggctcctaatgtgttaggggcttagaaaaattacttggccttacaaaccacagatctagagtgcaaaaagcattctttgttctgacagaaaaaagtgtggcgggggggatggggagagaagaaactaaccaatatcatgcaaggcagaactgaaactggaaggtttcgggcacaaagaactcacaatcctccacgggtcaaggcagtgcagctgggcttttgataaatatgagtatttaaatggctctctcttgggccagtaacatctaccaaatgtttttaaaatgctaccacccctggtatgttccccaggcccgagcccgggatttgaggtcctctgggtgagttaaaggtgagatgatgtggcaggggcttcttatgggtgaagagggtctcggctcctgaatgtaccccagccccaggccttctgctgccccctcactacaaatctctagggcaggggtcagcacactttctctatagaggacaggatggcaaatatttgggattctgtgggccatttggtctgtgtcttagctactccattctgccgctacggtacagaggcagccctggaatagaagtgaatggtgggcatggttgtgtcccaataaaactttatttatacaaacaggcagcaggtgggattcggccacagtttgctagcccctgctttagcacttcagccagcttcagggaccgtgctccagctacagcagggaggatcagactcaatgtactgaatgaacctcctccttcttgtccagttctttgccttggaacagacgaggaccttctccttcctgagaggggacagcctttcatcatcttctgctaagaggcgcccctccaccaccctgcatgagtaagacacagcctccctgcagcacagaggaggcttctgtgagtgcccacggcatcaccaaggtcagggagaacctcttgaggtaacttgcatttgtgtcacgaagccgaagagggttgcaggggattgcgtgatccccatcctgttcatgggccaccaccccagtccactcagaagataaggcctcctgatcagatgcaatgactcatgcatgtaatccccgcactttgagaggctgaggtaggcggatggactgagctcatgagttagagaccagcctgggcaacatggcggaaccccatctctacaaaaaatacagaaattggccaggactacaggtatgcatctgtagtcccagctacttgagaggctgaggtgggaggatggcttgaacctgggaggcagaggttgcagtaagccaagattgcacctctgcactccagcctggaccacagaaccagacattgtctcaaacaaacaaacaaaaaaaaatggaggcagggcctctgacagttaagggccacagactgggcctgggccttccttggttactataaggcctggctgtctttccttttcccttgaccctctgatgatcttgcaaagctccctctgggctcaccgtcccatcacccaacaagcaggcccagcctgcagggccaggacacttaccagaggctgctgctaaggggatgctcccagcctggaccatcttcctccttggagagctgtgggcttgacactgtgtcgctgggcgaagtctggctttgcagggggtgaaagccacgtggtggggcactcccgggccatgccatcctttgtggcacatgtgagacgaaggtagactctccactctagtaacagacgcatctagagtttgaaaaaaagtccacattccttatgaaaggcatgaaggaaaattccagtgaggagggaggcacaaaaagagcagaattcaatagatcattcattccactgggaaaacgacaacatggatcaaagctttcaatgtcaaaacttccaatgcaggctgggtgcggtggctcacgcctgtaatcccaacactttgggaggccgaggctagtggatcacgaggtcagcagttcaagaccagcctgaccaacatggtgaaaccccatctccactaaaaatacaaaaaaattagctgggcgtggtggtgggcacctgtaatcccagcgacttgggaggctgaggcaggagaatcgcttgaaaccagaaggtggaggttgcagtgagccgagattgagccactgcactctagcctgggcaataagagcaaaactgcgtctcaaaaaaacaaaacaaaaaacaacaacgacttccaatgcagcaacttctactgcagtttcttttaaggaagcactcagacagaggtccaaagatgatctacaaagatatttctcacagcattatttagaaagagtaaaaaactggaatagttctgtcaagtatggccccattcatatataaaatactatggcaactgttaaaaatacacaactctctacttattgacatgggaagatatatagcatgcatcagtaaatgaacacggcaggttacacagcaacgtgtggaccatgatcctatttttgttaaaagggacatttattcaagggtctggaaagatttgcactagaatgttaatgaatatccctggggaatggattcacctgtgattttcattctctacttcatatctttccttcttttttttttttaacaagcatgtatcacttttggaaaacatttctgaaaggctccaaggaaagaaaacagcatattttcttcaagtacttcaagccactaagcagaaaggcacagagttatcccacctgatacagtttcacatgctgatttccataatttagagagactacacgatctatatatcaggagagacattttcctaggagccaaccaaaacttcggaggaatccaggagcaaagccataatgcaaagatgtcaaccggcacaaatgcttctctcattgatgaatatttaacgcgtactcaggagattacagaaacagctcgtcacctcttatcatgggaaggttatcagtaggtggtgatatcaaggaccaccatgggcctgctcccaacacagatgcccacgtgtgcacacacagccacacatacatgcacttagtcacacacgcttgtgtgcgcacagctgcacatatgtccatctgcacatgcacacatgccaccacacatgtgcactcacacaggcacacacatacacatgcaaaatcacacacacaaaggtgagggcacacacacggagcaggtccacaaggctatatcaggacactccacgggtttctcaggaaacttctgctggataccatcaccacttactccctcccagccggtggggctggtggtcactcccacagaaacaggaattggccactgtgtagtcgagaacaggccttctttgtcctatgacttcatccctctgctatggtcctgcctccactttccaacagaatattctaaatgtcaagatcccatgcgggaacctgtggtcatctatgtaagttgactcatgatggacaaaccattaacaacatttaaaataacagtttcccctgcaaaggcttcaagccaaaattaggatgtgggtctcgggaccccacccagttattctcattattatgtggtacagggagactgggtagatcagggtctcagaccataatagatgggaaaaaagagaccccaggggcaggaggggaatgagcgagagagaattaagtttgtattaagttggagaccagggcagatggaaagacggaaggttaggctggcactgggagctcccttcttcaggggtcagctccccataggatctgcaaggaaggtgcaacaggatactcccttgagccatgtgacactccatgacaaaggcacccccaactatgcccctgggtgtcaacctccctatccttttctggttcatgacctcgagatgcctcccaaggcatcttgtctgaattcttgtgttctgaaccttggcttgttatatgtggcgcactttatgcaagttacacaaaactggactccaggcgtggtgctgcatgcctgtaatcccagacactcaggaggctgaggtgggaggattacaagcccagaagtttgagttcagcctgggcaacatagtgagaccccatctcttaaaaaaaaaaaaaaagggaaagaaataacttaattctttttttctggcatagagaggttccaaagaccaatcctgaagcttggtaaaggactacagctgttacccccacattctatcaggctattaagactcactcagccgcaacatggccaggcccccacaccaagttaggcaagctacagataccaaggagtaggaactgcaaacacaaatacagggcaaactgcaggtacctaatcctgacacgtcacctggctgaactttggtagcagaagcccaaggaacacagacttatggctttgtgtatatagacattgtcctgtagtccaaaggatgtgactctgtggcagacgggaacctagaacattggacatttattatattacattaactaccttgcttgcttccaggtttctggaagttttggtaacacagctaaatactagggcctagtttttgctaagaacgtgggtagctctgacattcctttgtccattaggcagatccactgtataaatggaaacatctgtattttaaagattttcctagctgattttatcgaaatgttagagattttcctggggcgagggatagctgcaagttattacagtcagatttctaagcacgatgattatttctggtggcaaaccatgcgtgtggaggccgattcctcctatcagcctaacgattaagtcaacatgctaagcagccacacgggggctactaagtgactcgcacgggggaagcaggcagggagacagatgggcaggggagggaatctggggcaatgcacaacctccacccaggtagagagagggtctgggggataggtctgtgtcactcaagtaagagcgacacttcttggggtccagtcccgtcctgggcttgcccgggaaagaccccaggacaaattcggcccccttccagagtgtccccattctgctcccacaatgggacaagccggcctcttctccagtctgggcccccttcggccctcctccctcctcctgtctcttgggcccccagccatgctcggcccccagttgacttcttcagtacctgcattgctcagcgtcttgcactctgtgcgtgccccatccgccgctcctcctgtcccgttcctcctgcctctctcagccccactcactctcccactgcccctcgtgcccccatccaaccctcctcctgccccccaacctctgtctctcagtcccaagccagtcagggagccctgacagcagctacccggacggcagtgcgagccccttacccgggcgcagcaggcccccggcggcctggtggccctcggacagtaggaaggagcctgaggcccggcgcggggacgtggccggcagcgcaacccaggcagctccgggcagcgcgccctgcccgggccccgcccaaacgccggaaatgacgtcacggagggcggggcgggcctgctggccggggcgaagagcggctgcggcggggcctgtggcgaacggaggcgagccggaagtgggggggttgtctgctttcaggccccgcctccccggggccggctcgggccacttcttgcgcgctgccagaaggagctattttgagcaggtctgtggcggaagtgggtgttcccgggtctctgctgcccagctgtgcccgctgccgtcttggggtcccggggtgcgtgggttgggctgggtgagctcagaggcaccttgtcggcagccgagcctgaagaggcgacctcgaaacgcctcgtgagacctttcgcgggcacacgcccttcgcgttcctccgcttcctcccacgtttcttcagcccctggcggggcgctggggtgcccggtagttaagggtggggtggcagcgagcgtttctgtgcacccgcagcgtgccacgcccgtgctaagcactttgcctatagagccagtggcttaattctgcaatagcacagtgaagaacttcgcctcattttacagacgtggaaacaggctcatcaagtgctctgtaattgtaaaacctgggataacaaaggagcaaaacgcaatttagaggcaagtgtgtgggacttgactttggttagaaataggctttgcaggccaggcgcggtggctcttgcctgtaatcctagcactttgggaggccgagacgggcggattatctgagctcaggagttcgagaccagcctgggcaacatggtgaaaccctgtgtctactaaaatacaaaaaattagccgggcgtggtggcgtgcgcctgtagtcccagctactcgggaggctgaggcaggagaattgcttgaacctgggaggtggaggttgaagtgagcagagatcgtgccactgcactccagcctgggcgacagagcgagactctgtctccaaaaaaaaaaaagaaagaaagaaataggctttgcaagttagtagttctgtgactgaatcccagtctgtataagaccctcaggcatcccccggtccaaaccaaaacctgtctgcgaaggatgatttcacaggagcaaaccaagactttatttccagttttataacctgccttggggtcttcggctaggaagctaagagacacagaaagctgagattgggcaaagacaggatctaccatccactccgagctctgggagcacctgaaatgcgatttgatgtcaccaccaccatccccagttcaaccacagttcatgtgtggaatttaacctgcaaagttgggtttgctgagacccaacgccggttggatcatgtgaagatcagatcctttcactatgtatttgctttaatttttccaactagttcggatctaacatgaagtacagtattgaggctcactccagaagtgaaaatatacaatcggcaggcagattttagttctttgcctgcccttttcaaaaatcaatgactgggctgggcgcggtggctcacgcctgtaatcccaacattttgggaggccaaggcgggcggatcacctgaggtcaggagtttgagaccagcctgaccgatatggtgaaacccgtctctactaaaaatataaaaattagccaggcgtggtggcgtgtgcctgtattcccagctactcgggagtctgagacaggaaaattgcttgaacttgggagggggaggcttcagtgagccgagatctcaccactgcactccagcctgggcgacagagcgagactccttctaaaaaaaaaaaaaaaaaaaaaaaaaaaatcaatgactgtgactctgttttcatttcctctttggcaacatagggacaatttttactgctggggctgaaattacaaacataagacacagcctctcctctagagcagctgggcagctaaacctccatctgcttgcttttttttttttttttttagacacggagtcttgctctgtcgcccaggctggagtgcagtggcgccatctcggctcactgtaagccccgcctcacgggttcacgccgttcttctgcctcagcctcccgagtagctgggactacaggcgcccgccaccacgcccagctaattttttgtatttttagtaaaaacggggtttcaccatgttagccaggatggtcttgatctcctgacctagtgatccgcccgccttggactcccaaagtgttgggattacaggcgtgagccaccgcgcccagcccatctgctttcttaaatttctattggaacagagtcatgcctcttcattaggtattatctgatgataaaagggcacagtcgactagttgtagagactatatggctcacaagtcctaaaatatttactctctggccctttacagaatctatttgctgatctccagtctagagtgttactgatgggtttctgacacagaaatatctggctgagatggtccaacataccgggaaactcattctctcctatgagaaagtcatattctctgatagcatctttggtcacctgaaacctagtgtccattgaaggcacagctctgggaactgcaaaactgttctgtggagtgttatggagagtaaagccaggcagaccagctgcttctgagggctgtggataaaatagagaatgatacacttacatcctctaccttttgtttccaggcacagatcatttcaggtgccttctgtgcagaaatagctgaataaacttggagcttggtctctttgttgttgaatttacaatgttatttgaatgtaagaccttgtagatatgacatttgaaagttagggctctggaatggcactgcctggcttcagatccttcatttttttgctaaatgacaacaaacaagaggcttaggctctgtgcctccgtttcatcatagtcaattctggtatttgcagtagttatgttgaataaagtcacccagtacacggacttagcaaatactgctccttggaaaccacagctcctagggaagatacagggttaggttcctgtgaacctctgatcacaacatttttatcaacagatcaatatacataactttgtttttgtgtgtgtgtttctatttaaagatgctttatttaggccagacacagtggctcatgcctataatcccagcacttcgggaggccgaggcagatggatcacctgaggtcaggagttcaagaccagcctggccaacatggtggaaccctatctccactaaaatcacaaaaattagccaagtgtggtggcccatgcctatagtcccagctactggggaggctgaggcaggagaatcacttgaacccgggaggtggaggctacggtgagccaagatcacgccattgtactccagcctgggcaacagagcgagacttcatctcaaacaaaacaaaacagaaacaaacaaaaagaagccttatttaatgtctattattgactcattaattaacattgaaaatgagatgggaataatatagggtggtcacaggagaattaaattccaggcagcagttttacataactagagactatcgtcttctaagaccctgaaaagccaaggtatgaaccaagctggctaagaccaactggacccaacatggtgctgggcttgacccaggcttcccctaggacctcattatgtgctcattaacatactaaacacacaaccaccagtaccatgacaatttcaggaacactcagatttggcgcataaatgggtgacaccaccgctccaagaaatctctaccttttcccaggaattttcatgaatattccacctcttggttgaagaaacccataaaggtagaaaccccgaaccattgctcgactttctcttgagtaggcctgcattcctctttcttgagtatgtaattttcacctggtaataagtctttgtactttcactattttctgactcatccttgaattccttttcgtaatgacgtcaagagcccggggtcaaggtcccacctgcgtttgggcacctccccagcccactggtatcaaacccacagacaatggcatgtaactcatgcctgaatgaagtacatctaacatgtattttctccctaagacacaccttttgcactgaggaacactagataacacttcaaccctacgtgtgggggccatttaaaaatgcaaaaccgccacccaaaaaaaagcaaaaaatgacaaaaatgtggcgctaaacagaccaagaaaaggacagttgttggcagtaggtgagcagaaatgagggcagagagagagtgcttgctgggtctcagccagggactccaacacgcggcgactcggattttccccactccaggcacatggcatgtacaggctcatggcctcagaaacgctgcaagtattgatttgtggggggagggggggaggttacacataaattttttacctactaagtgaatttgcaaatgtggaatctatgaatcatgagaatcaactgtatgctaaaacagaggagtaataggacctgcctcatcagatggctatgggaattcaatgatatatgagtgcatgtaaattgcttataatggggcattacacagagaggactgagtattagccactttttttgtgtgtttttttgtttgtttttgttttgcttttgagatggagtcttgtcctgttgcccaggctggtgtgcagtggcgcgatcttggctcactgcaacctccaccccctgagttcaagcgattctcttgcctcagcctccctagtagctgggattacaggcgtgtgctaccacacccagctaatttttgtatttttagtagagacggggtttcgccatgttggccaagctggtctcaaactcctgacctcaggtgatctgcctgccttggcctcccaaagtgctgggattacaggcgtgagccaccacccctgggcccgttgttactattattgattacaaaagagcaggactctggtatttggaagaggattctctagagtttggaacaacttgaagtccctgagtcccaaaccattccgaacccctccacggtgccaccttcgtcacaccaggcagaagcccttcccttgtcaccggaaactccctctggaaggagctgttctctgtcattaaagggagttccctttcaggaggaagccaatactccccttcatgctccaccctttattgtcattatttgaaaatagaaggtttatttttatgttctgaacacaaaactaagaatattacaattatgagaattttgagaataaaagtgaataattgatggggataggagtaaaattaaatatgcattattggtctgagcctcctgacatgtctcttataatgttcagaagtattaatttggttttcgggtattcatcatggatggccaggggaaaattcttaaggctactacggacttactctgagtttttttatttcaatttttttaaagcatattaatttcaataaattgttacttaatttagttcacatgtatttgatatggtttaaataatttttattgaggattagtatacgtccagaaaagtgcacataaacgtttacagcttgatgaattttcacaaactgaaccaccctgtggaatgaacactcagtaacagtggcaccagcgtcctgggggctcccttcaaccccccttccaggcccaaaatgaaaatgccaagtatctgtgaagactcagagcaacctgaactcccatagagttgctggtgggaatggaaaatggtacaaccactttggaaaacagtttggcagttaaacatacacatacgtgacccagcagtcccactcgtaggtatttactctagggaaatgaaaacatacatccacacaaatatctgtaggaagtgtttatagcagctgtatttgtaattgccaaaactggtaaaggaaaagcttgttctactcacaacacgtctgacatccatgtgtaggttttcttttcttttctttttttttcaagacaggatctttctcttatcacccaggctggactgtggtggcacaattatggctcattgcagccttgatctccaaggttcacaccatcctccaacctcagcctcccaagtagctgggactatgggtgtgcactatcctcagataattttttttttttaatttttgttagagacaggggtgtcactacattgcccatgctggtctcgaactcctggccttaagcaatcttccctcctcggcctcccaaagtgctaggattacaggtgtgggccactgtgcccagcccaacatgtgggttttccacaccaagcaattctctgcagacgccaactgggtatcctacaatttaattcaattttgacactaactctgtggagttagcacagaccccataggttaagagctcagtcccagaagactgcccctgcttcaggcatcaaccccaggtagtgggtccccaggttaccacactggctacaaatcagaggggcccacgagctcctccttagttttgtcatttgctagagctcacagagctcagggaaacaccttacttccagttgccgatttattataaaggatacaaatgaacagcagatgaagagaagcatagggcaaggtctggaagggtcccaaacccaagagcttttgttcccgtggagctgggggtgcaccacgctcctggcacatgtatgtgttcatgaaccacaaagttctctgtaccctggcctttataatttttttttttttttttcgagatggagttctgctgttcttgcccaggctggagtgcaacagcgtgatctcagctcactgcaacctccacctcccgggttcaagtgatcctgctgcctcagcctcccgagtagctgggattataggcatatgccaccacacttggctaatttttgtatttttagtagagacggggtttctccatgttggtcaggctggtctcaaactccccacctcaggtgattcacccgccttggcctcccaaagtgctgggattacgggcatgagccacttcgcctggcccaggcctttagacttttatggaggttttattatatcggtgtgatcgattaagtaattggccattggtcattagctcaatctcagcctctcttccctccaaagaagtgggaaggtggagtggggctgaaagttccaatcttgtaatcatgccttggtctttgtggtgaccagacccctcataagctatataggggtccccagccatgccagttgtctcattagcatagaaaaagacaccatgatcactcctgagactccaagagctttagaagctgtgtgccaggaacaggggcagagaccacttatatatttctttttatgtcacaactggacacacccaaatgccaatcaatgggtgaatgaatggatatacaaattgtggtatgcctttaaaatggacactacccagccataaaaagtcacgaattaccggccaggcacggtggctcacgcctgtaatcccagcactttgggaggccgaggcagatggatcacatgaggtcaggagttcgagagaagcctggcaaatatagtgaaaaactgtctctactaaaagtacaaaaattagccagcatggtggtatgcacctgtagtcccagctactcgggaggatgacttaggagaatcgcttgaatctgggaggcgggggttgcagggagccgagatggtgccactgcactccagcctgggcaacagaacgagactgtttcaaaaaaaaaaaaaaaaagttaccaattaccgatatatgcaacaccaccgatgaatctcaaaagccattatgctaagagaaagagaccagctgtaagagatgacatacagtaggattccatttatatgacattcatgaaaacaaaaaagtatagagacagaaaacagtagctgccagggatgggagtgggaagacaggaaatgacttagcgttgccagagaaaatacaggtcgcccaggtaaacttactaaatctggcaaccctagattgtctacagagggggataaaggaagttttggggatgatggaaatattctatattttgattgtggtgatggttacttgcctgtgtgcatttgtcatggagtcatggagatgtaaattttactacatctaaattatacctcaataaatgtagctaaaaacaaaacagctgtaaagaaaggtaaaagtcaaaaatggaaaaatggattatggattatggtagttaatgtgtgtgtgtgtgtgtgcgtgcgcgcacgtagaattgaacacttaaaataggtgcattttattctatgttaattatacccccaataaagttgattcttttttttttttttttttgaggcggaattttgctctggtggcccaggctggagtgcagtggtgcgatcttggctcactgcaacctctgcctcccagattcaagcaattctcctgcctcagcctcccaagtcgctgggattacaggtgcctgccaccatgcccaggtaaatttttttttttttttttgagacggagtctctctctgtcacccaggctggaatgcagtggcatgatctcggctcactgcaagctccgcctcccgggttcacgccattctcctgcctcagcctcccgtgtagctggggctacaggcgcctgccaccacgcccggctaattttttgtatttttagtagagacggggtttcactgtgttagccaggatggtctcgatctggggacctcgtgatccacccaccttggcctcccaaagtgctgggattacaggcgtgaggcgtgagccaccacacccggccatgcccaggtaattttttgtatttttagtagagacagggttttgccatgttggccaggctggtctcgaactcctgacctcagctgatccactcgcttcggcctcccaaagtgctgggattacaggtgtgagcctccaggcctggccaaagttcattctttagaaagcaatattaaaaataaagaaggttggccaggcgcggtggctcacacctgtaatcccagcactttgggaggtcaaggtgggggcatcacgaggtcaggcgatcgagaccatcctggccaacatggtgagaccccatctctactaaaaatacaaaaattagctgggcctggtggcatgcacctgtagtccctgctacttcagaggctgaggtgggagaatcgcttgaacccaggaggcagaggttgcagtgagccaagatcgcgccactgcattccatcctggtgacagagcgagactctgtctcaaaaaagaaagaaaagaaaagaaataaagagggtcactttatgataaatgataaaaaattcaactcaccaggaagacgtaacaattctaaatattctaaatcagaatgtaccgataacaagacctcaaaactcgttttgtattcttttggaacttgagaaaataattctagcattcatctgtaacactaaatggtcaaaaatagcaaagaagttagcatgcctttatttctcaaaatggctacaaaatatttattacttttataatagaaaaagagtgtttttgttttgttttttgttttttaagacagagtcttgctctgttgcccaggctggagtccagtggcacaatctcggctcaccacaacctccacctccctgattgaagcaattctcctgcctcagcctcccgagtagctgggactacaggcgtgtgccaccatgcctggctaattttttgcaattttagtagagacagggtttcatcatgttagccaggctggtctcgaactcctgacctcatgatctgcccgccttggcctcccaaagtgctaggattacaggcgtgagcccccgcgccctgctgaaaaagagtgttttaaaatagaaaactgttttttaggagaaatgctctttagcaacaacaacaacaaaaaaaaaacccaacttaatcccaatacacattttaaagtagtatatagcatgcaatagctgaggtataaaccttcctatccattccttattaaattattgccggaagttcaagtcactccactcaaaaggacttcacataagtgggaaaatcgttctttgagaagaaggtatatgatttgatattgttttgcctagagaagaaaaagaaacaaacccattagagtgttgcagaacctgaatggtttttcaagaattatgttgatcaactttctgtgtagagtagcaaataacaagtgtcaccgatttgaacaatagtgtatttgggaaatagagaaagggctgcttcctgtcctttgagatcttcacagcaaccacaaaccctatcttgtcatctgtgttccggcatgcccaggcacatttgaccaattctaaacgctaaacgttactccagcacccaagtgtaacccgtcacgaggtgagtcacaatgaatcctaaccaggaccccagtgggaaatgtgcctcccctttagatttctgatttcacttcagtttcccggtagcacttatggtgtcattgatcacccctccccaccccccatctctttcacaattttgtcttccgtgggtcacgtatgttttggagatgtctgactttcccaagagctggtgttgaatttccacccagtgtttccaggacagcagcctgtgtgaagtgctagggaaagccttttcatgccttgaaaaatacacacaagtatttctcttcctgagcttcaaggagactctgcattcaaaagaccactcccgggcactgccttctaccaacttccccatccaactctgattgcatcggaccactgtcttccctccatgcctccagccctgaggttgtcaacggggtgctccagcctccatgtgcaccctgtgacttctttcatcctagtccttctgaccctcgtggcttctcctgctccaaggccaagctcgggaccctgtcatcatccccggggacaggccccatcttagagaggatccacccagctccccgctcctgagccatcttccagctatcccgcctcgagactcccaccgcacctgctcctgggctgcagctgcacccaacaagtaagtcattctcttgccaatagagtgtcttccacgtccttgtccttcccacactccccttggcaaccccaccccgccggatgaatccagatgcccaccttcatgcctgcccctgggtgggtgctgagggagacccgtggctttttcccgcaaccaggccttctgcgctgccagaaaccccatgctcacctggcatggcgctcgcacccagccccctccaccattttcgaacccacctcattctctttcagcaggtcttgcctctttcttcaacgagaaaatagcagccctgtcatgggaactcccttaactcccttcctccctgcctgcacgaggcctgaagaaacacacgtccatccttttctcctcccttccagtagcattggaagaggtgttctcaccagtgaaatatcttctcacctgagatgtgggttctatcccccacaatctcctggggaactttatcccactgattaactactgcctctccgggacgtcccacctgtctctactggaatcttacctttttttttttttttttttttttgagatggagtcttgctctgttgcccaggctggagtgtagtggcgcgatctcggctcgctgcaagctctgcctccgaagttcacgttattctgcctcagcctcctgagtagctgggaccacaggcgcctgccaccacacctggctatatttttgctgtcttgttcagaaaagatggggttttccccattgttggcccaagatggttcttctatctcccgaatgaatgcattttcccctgtttgggcctcccaaacttgtcgtgcaatcttccgcattccacctatgtgagcgggtcgctgatcgctcctccactggtgtgagttggttcatccgctctctactggcctcgctacctctttatcttgcttattcagcatctagcctgcgcccgcgtcgtgttgcgttcctatgcccttgccgtgcacgctctctgccttcc

SEQ ID NO: 23 - DNA, 17705 bp, Homo sapiens
aatattcttgatgatgcctgctgcccatgatgaaaatcccgccacctgccctcctgccgtgtccctccacctgccctcctgcggtgtccctccacctgccctcctgccgtgtccctccacctgccctcctgccgtgtccctccacctgccctcctgccgtgtccctccacctgccctcctgccgtgtccctccacctgccctcctgccgtgtccctccacctgccctcctgccgtgtccctccacctgccctcctgccctcgtgccatgtccctccacttgccctcctgccctcgtgccatgtccctccacttgccctcctgccctcatgccatgtccctccacttgccctcctgccctcctgccatgtccctccacttgccctcctgccatgcccctccacctgccctcctgctgtgtccctccacctgccctcctgccatgtccctccacctgccctcctgccacgtccctccacctgccctcctgccctcctgccatgtccctccacctgccctcgtgccatgtccctccacttgccctcctgccctcctgccatgtccctccacttgccctcctgccctcctgccatgtccctccacctgccctcctgccatgtccctccacctgccctcctgccgtgtccctccacttgccctcctgccctcctgttgtgtctgtccactttccctcctgccctcctgccatgtccctccacctgccctcctgccgtgtccctccacttgccctcctgccctcctgttgtgtctgtccactttccctcctgccctcctgccatgtccctccacctgccctcctgccatgtccctccacctgccctcctgccacgtccctccacctgccctcctgccctcctgccatgtccctccacctgccctcttgccacgtccctccacctgccctcctgccctcctgccatgtccctccacctgccctcctgccacgtccctccacctgccctcctgccctcctgccatgtccctccacctgccctcttgccacgtccctccacctgccctcctgccctcctgccatgtccctccacctgccctcctgccgtgtccctccacctgccctcctgccgtgtcccttcacctgccctcctgccatgtccctccacctgccctcctgccatgtccttccacctgccctcctgccacatccctccacctgccctcctgccttcctgccatgtccctccacctgccttcctggcgtgtcctcgcacctgccctcctgctgtgtcccttcacctgccctcctgccatgtccctccacctgccctcctgccatgtccctccacctgccctcctgccgtgtccctccacctgccctcctgctgtgtcccttcacctgccctcctgccatgtccctccacttgccctcctgccctcctgctgtgtccctccagcccctccgctaagaaagcctcaactcccgttcactgtggatgagacgctgaaagggaccctgcccgttgtggcagagtgcgtatcgaggaggatatcgggagccgagaggaagttcgctgatcattggcaccaccagtttgggtctcactggagaatagccactctattcaactggatattttggtgttttccttccagacttttccctgtgtaatttcaggcatttgtagttacctggggaaacagttgctttgttcttctttgacgtatacatgaagcattgcgattttcactctgcagcctgcctgttcacgcagccatgtcttcttaccctctccattttcatatggactttctggggggatgagctgtagccacgtgtcacatgtggctgtggagtacttgacacgtggctgttgccaccgaagaactgagtgttgaattttgttgcattgaaattttcatgaaatagccgccggtggtcagtggctcccgtgtgggacagcgggtgcaggtctccttgctgagaaatgtttaggccattccccttgttgacctcttgcacacacggacgtgtctcaaggaggctgctgagcgtgggaagtgctgggtctcacaagggtcctgacagtggcagcgtctgcccgcctgcccctcattgcctcctgctgctgctggccacagtacaggagttggttctgtgctgagtttctgtagctatgagtatatcacttacctgtgttttttcacacagctttttttttttttatatatatcagggtgacactttgcgtatgtttcaggtgactctaatatcacaacatggtttacttacagcctcagtggatgtttcagttgcttctatttctctttgggtgttacaaagaccactgagatgaacacctttgtgtataaagcgatttctgtgtctgggattatttcctgtggctggatagataggacgggagatggggtaggaaaaaatcaaatcccagaataagagggtgtgagcatttttgggctgcaacagccacggctgctggcctgtgcttctgagcacgtgtgttccttgcccagcacccgccgaggcccgagtaccagtctccgtttctgcagagcgcccagttcctcttcggccactactactttgactacctggggaacctcatcgccctggcaaacctggtgtccatttgcgtgagtgtggatttgccccagagctggcgcggaagtgccggttcccgcccaccttgcaggggagcctgcccctcctgcctcgcccagcgctgtgctgggccagccggcgagccctctgttctggcgttgcaggtgttcctggtgctggatgcagatgtgctgcctgctgagcgtgatgacttcatcctgggggtaagttctgagctgtccacctgtcagggccagggtgaggctgggcagtgctggcagccctggggcccaatgctgggtgcctcttctgcccctttcagattctcaactgcgtcttcattgtgtactacctgttggagatgctgctcaaggtctttgccctgggcctgcgagggtacctgtcctaccccagcaacgtgtttgacgggctcctcaccgttgtcctgctggtaaagtaggcgcatccgaggccggcctctcctgggcgggtgggtgagcgccacctgggctctgtgctggcccatctcaggcctcccctgaggactagaggctgtaggaaggtgggcttctgctctcagtggtgagggctggcttccctgctggccgagttgctcagtgggcagccggtgaggtctttaggaggctgggtttctactgcatccgagtgtcatggggggcaggctgcccctcccgacccccaggggaagccctgaaggacttgtagccctggccagcgactccagcccggggaacagcctcttaaacgtcactgatagacggtgtgacctcagcatgggtggagcgaggggccagggggctctcaggcaccagggtgttcttgggaaatgcttacacttcctttccccagacccagtgggagtgagggcatgccacacttggtgtgtgtgtcacaagcagccacatgagagtgacgtttgctgtagccagcaggcccctcggcacatgggtgaagagaaatttgaaaagggccctgcagtctgtccttgactcagtatcttctctgccacctctgccaccccaatctgtgcagtcccccgattcctgaggccagggtgtctttccagctgaaagaagtcccgacatctggaaccaacctgtggggtccaggaccaagctctgatttctccccaaaagccccttttggggagaatgtgttagagatgagctttataataattcctttaagggccgcccagattagtgttgctgtagcgaagccttcttttcttttgtaattaaaggttttggagatctcaactctggctgtgtaccgattgccacacccaggctggtatgtgactgggcagaaccgagggcggctacagcaaacagcaccaccacccagcgcccctgggagggtctcagtggtgtccagggggctgggtctgctctgactctagggcagaccccgtgatggtggaatgggtgggccgatcccacagcagaggctgtgtcggggcagggccctgccgtcgctctgggggtcctctctccagaagctggcaccccgcaggctgtggagggaagccgttgttcccccttggagatgccctcccgggcggcagtgggctccccctcccagcacacatgctgggggctggcagcagagatgcccctggctcaggtctcaggggacctgtgaccactgggattcggctgggcccctctgctggcgggaaggtccttgggagagcccctgcctcacagtgtgaccttgagtcatcgcctcccactctggacatcactttagcctccttaaaatagtggagctaggggcccggggctcactgaactctgaggctgtgtgctgattcaccactgcccggggttctggccatgaagagacaacctgggcagggaccctggagcctcgtggcaccacagggctgtcagccaggctgctctgccctgagagcgtggctctggtgtgcccgtgatgagacaggaagggtggggcacggggcccagcatgccagcctcggccctgtggttaggccgggctccttgggtctctgtgtgctgtgtcatccaccccactgcctagggagcagctgggagtcgcttggtgggggtggggacggtggacagcaagagccttgctattccgtcagctccctaggaagccccccagaacttacctcaggaaggcaggcagtgccactgtgctgtgccgtggggctggcattgccttgtctttcatgtgcactgagcatgcccgctgcactttgttctgagtcattaccttggggggctgacactgtgggtgagaatgggtttgagtttcaacagaaatgaaagcatggaaagaccatgagggatgccaagcggggcttgggtcagggatggggtcagggtcagggtcatgggacaggaggtgggcgatgggggcaggaaccaggggatggggctggcgcaggagaccggggcaggagacatgggctcacgcagttctgctggggcctgagctggagcaagtctcagtgtctggaacctccatgccctcccgtgtggacagagggtctgtgtagaaggagggctgcagccttcccgcgagggctggctgggaaggtgttggggggatgggggtcgctccggggctgcaggtggaagcggagcagtgagtagcccaggccccgccctctcgccaccctgcagaggcttttctgctcggtgttggctgtggggtgcactcccgtcatgccctgttgccctccctgcgcctccgtccaggaacccgcgcgtttccttgtctcctccctgtggggctcctgggctcctcccaacccgcctcccgtgtctctccccaggaggccggagatggtgggcctgctgtcgctgtgggacatgacccgcatgctgaacatgctcatcgtgttccgcttcctgcgtatcatccccagcatgaaggtgtgtgccggccccacccccactcgccccaccctcctgggtcatgctgctgcgttgctccagggtgggtgagcctggggcaggaagggcccgaggactgtgcccgtcaccctgggctccctggctgcaccctcagctctctgccgtgctcttgtgatgctggggaagggtcattagaagcaggagagcccagccctgcatttctgggttgggagaggaaggcgggcaagggtgtggcgggtgcaatgctttggccagtggcaggagctccttggggctggagccctggacaccagtgctcccccaggtctctgaggttcccagaaaggcctttgccatggctcccagggtgctattaatgaggggcagtggtacccctggccagggagcttgtttccaggatcctctaatgcgggcgcaggtggctcatgaccatctctgagggctggtttctcttaatgcaccggttaggagcaatgggcaccttaaaggggcaggcaggcagaggtcgggggtctgggccttgctgctcctggcatcatgtcctaagacccatgttctgagtgtccaggtccctcctctgtccccgttcatccttcctctgagctgtgcacctgtcccacctgacagtatgtcccacttgaaggcagctcaggggtcctgagccttcctacggggctgctgtgctgggaccttcatacgcacacacacgcgcacacgtgttcacacataattacagccatacaggcacaatcatacatatatacaatacagccaagcacacgtgatctcacacacaaccacacatgtgaccatgcacatgcatatacacacacaatcacaggcacacatgatcatacacagtcacacatatacaatcatgtttggatacaatacacatcatcatgcacatacacacgtacattaatacgcacgcccgcatcaccgtatgcacagataatcacatgcaaatatccatgtgaactcatgtccgtgtaagacgcatgatcgtgtgtgcacacatcgcatgcagatatccatgtgaactcgtgcccgggtaagacgcatgatcgtgtgtgcacacatcgcatgcagatatccatgtgaactcgtgcccgggtaagacgcatgatcgtgtgtgcacacatcgcgtgcagatatccatgtgaactcgtgcccgtgtaagacgcatgatcgtgtgtgcacacatcgcgtgcagatatccatgtgaactcgtgcccgggtaagacgcatgatcgtgtgcgcacacatcacgtgcagatatccatgtgaactcgtgcccggataagactcatgatcgtgtgtgcacacatcgcgtgcagatatccacgtgaactcgtgcccgtgtaagatgcatgatcgtgtgtgcacacatcgcatgcagatatccttgtgaactcgtgcccgtgtaagacgcatgatcgtgtgtgcacacatcgcatgcagatatccttgtgaactcgtgcccgtgtaagacacatgatcgtgtgtgcacacatcgcatgcagatatccatgtgaacttgtgcccgtgtaagatgcatgatcgtgtgtgcacacatccacagtaaggcctcagtgctatccacaggttcttggaaactgtgactttaagggaaatggcgcacagcagaccctgcaatcatgccgttttgcttgaagtcgcagtttcccaggacctctcacgtgagtatatacatgctcacgatgacacgcaacgtgtgcacacgtacatgctgactggtctccactgtggcgttcagctgtgttgtctagtttggattcctcaggtgggttgatggggctgatgtgaaggcctttctcccggctaggctgtgatgaggaggagcggctctttggagccggggcctccctgctggttctcagaggccccttctcagactcagttcctgcaggtgctcctgccacctctagctctgcatttctttggcgtctccaggccacagagtagctgacccacctgcagtgggttgggaggcagagaagggcctcccacaggaatttgaagtccgtgcttgaatgaggctggggtggaggtgttgggatgcgggagtgggtgagtgagtgcgtgcgggtggcgatgcaagcgtgtgcgaatgcgtgtgggtagatgtaggtgttggggtgcgagggtgtgtatgggtggacgtgggggcctgacaggctgtgtgggtgtgtagaggcgtgtgggggtggctgtgggtccaggtgtgtgtgtgtgggttggtggtcattggcctgccccatcttgcctttctgtcagggtcagcgtggtgggccgggatggtgtcccctcagtggggccaggaggagtaagggctgtgctctcttcctgtcctcagccgatggccgtggtggccagtaccgtcctgggcctggtgcagaacatgcgtgcgtttggcgggatcctggtggtgagtcccaggctgctgctggtggcgggttatgcactggagtgggaggctgggaggctggcggaaggcagtgccgggccggctcactgctctgtcggtaggaaggttcttgggttcggacggcagcaggttcctgaggccagggaagtacagggtcggggtaagaagccagaggcatccccttctttgtacagcagggagctcgggtggtgtggctggtggccctgcctgagcatccttccctcccatggcagagactgtttggtaatttttgagtctctcgtgttttctgggttgtggatctcgttgagaaagtaatgacagaaatttaagaggcgcagggctttgctccagggaccccaaagcctgcacaagccctgggatgaggacttggtcgaggctcctttcttagaggaatttcagggactcacagccacatttgctgagcgagaactgtgggacgccccggcccctccctgggggccagccttccagctgaggagcccatctgctctgcctggtggccgggcttgggcaggagaggggcctgtgaccaggcaggccccagatccgcgccgtgcagagtgacaggaggcgccctttgcaggaagcccggccacacttcaggcagttttgccattttattctgaccaccttgacgtagggaccactggggtgagaaggtgtctctggggctgcagggtgctctgggctggaccccagctgtgcctcgcgcctctggaaatagacgctgggaagagaatcttgcctcaggtgctgtctgcccagccccctaacttgcacagcagaggaaactgaggcccagaaaggggaccaggttagcccaggcgtgtaccccttccactctgctgacgcatgttagggacaggcctggggttggcgggcagcctgtcccctaactgtggctgccagggtacctgggggcagggccctaattcccttaggagctccatgaccacgcctgcctgagccccactgtgtctgtggacccgccagccctgggggaggccagctgcgtgtgttttgaagtagcagccaggctggaatcccagccctgggcagagggtcctggcctcacagtcatcctctggctttgcggttctgtctggggagggtggtggtgggtgcacccatgggtggggctgatcagtccccggctcctggcccgccaggtggtctactacgtatttgccatcattgggatcaacttgtttagaggcgtcattgtggctcttcctggaaacagcaggtgaggtggggtccgaggtgccacagggagtgtctcaggggtgctggggtgggcgggaagccttggcggtggcctcagtgggctcagcatctcaggatgggagggtgttctcccagttccttcgtctcctccctccacccccttttcccgacccccaatttccacctccgctccgcacctctcctaggagcccttgcctggagtctgctaaacacatttctcgtggcctgctcagagcagcactttccctgccctctgagcctctgtatcccaatttggaccttcaggccaggctgagcacgccagcagaggaaaggggtgtaaggtatcaggcctcagaacctggagcccccgcccctgacccaggtgtgttgtgttccccagcctggcccctgccaatggctcggcgccctgtgggagcttcgagcagctggagtactgggccaacaacttcgatgactttgcggtgagccctgcgccctgtcccagcaccctgctccccgggctcctcccctccctacctcctgggccctcctggaccgctggtctctgcccccgcaggctgccctggtcactctgtggaacttgatggtggtgaacaactggcaggtgtttctggatgcatatcggcgctactcaggcccgtgagtcctcgtctccctgacggcagtgattctccgtgcagcctgggggttccctcacctccgggcacgctgcatctgcactggacgcccggagcgtggctgggatggggactcgggccttgacagggaagtcggccagcgtggcatcctggcttgccttgtccctgccccctgcatagccacatcgtgactctcaggatggtggccagtgactctgggtttacacctcctggaggtcgttggtgtgtttggggcttctgaggaattccatgggggtgggggagccccgggaaggctgagtgaacgagatagttcagctctgagcttgaagagctcagactggccccagctgatggtcctgggttttaatcccagcaccgcctcctgctggcttagctacctcggcagcttgttgcacgtttctaggcctcagttgggttgtttctgagatggaaatagtaacgcgctctgcatcatggtgtgtgtgggccggctgcccgagagctgtcctggccacgcagcagtggtgtttgtatcgagtgctcttgctttgctcatcgtggttcacagggtgggtctctgtcctccgcaggtggtccaagatctattttgtattgtggtggctggtgtcgtctgtcatctgggtcaacctgtttctggccctgattctggaggtatcagagatccccacccaggctgttctccatggtcgtttgtttctaattcactctcgatgggcctgaggccaccggccgggcctgcctggaactttgatgggagagtcgtgctgggttaggcgggtcctgagtgaggctgagcccctcccgtggggctcagtgctgcccgccctggctgctggggccttggggagtgctcctgacatctgggctgctggggccttggggggtgctcctgacatctgggctgctggggccttgtggggtgctcctgacatctgggctgctggggccttggggggtgctcctgacatctgggctgtggggattctcaggcccccaggtcgggctgaaggagggacttggacattggctccaggaggagccagcagcctcgtggggcctgtgcctgggtgtccagggtgaatggctcagccccctcagcgggtgccctgtggctgaccctggaggggccggggatggggcaaggctgctttcattcggggcccacactcactggccactcctcctgcttgccagaacttccttcacaagtgggacccccgcagccacctgcagccccttgctgggaccccagaggccacctaccagatgactgtggagctcctgttcaggtgtgtgggtggggaaggcgcttctgtctggccccctgggatgggaagccaagagctggggggtggaggggttgaggcggcgggcaggccctgatgactgtcctccccctccgcccggttatctggctttggtcctgtgctctaggagagcagctcagagccgggatcggggcggcttcttcttcctgccactggcgtcatagcctttgtcctgctctcctgctcttggattgggcatatttaaggcaccatccttcagggtccattggatcctgttggatgtaaacaagggacctgaggaaaccgcacccatctcttctcctggcagctttgagatggttcctctgctagtccagaaaagtgaccacccagaggcagccctgctgtggggcctctgtgccttccaccaggggctgccgagttgctgcagccaagccctgcggtcctgccagccagtgggaagacgtggcccctgggcttttaagaatgccgtgtagatatttctagtggctacatccatccggaggctcatctgagtccccgtgtctctgtgtccctgtgacactcacttcgcatgtgttgctaagctctgctcccttgttcttgtgggcaggccagggtctccctcctttagaggcccctgtgtgcatctttcctcaattccacagggatattctggaggagcccggggaggatgagctcacagagaggctgagccagcacccgcacctgtggctgtgcaggtgacgtccgggctgccgtcccagcaggggcggcaggagagagaggctggcctacacaggtgcccatcatggaagaggcggccatgctgtggccagccaggcaggaagagacctttcctctgacggaccactaagctggggacaggaaccaagtcctttgcgtgtggcccaacaaccatctacagaacagctgctggtgcttcagggaggcgccgtgccctccgctttcttttatagctgcttcagtgagaattccctcgtcgactccacagggacctttcagacaaaaatgcaagaagcagcggcctcccctgtcccctgcagcttccgtggtgcctttgctgccggcagcccttggggaccacaggcctgaccagggcctgcacaggttaaccgtcagacttccggggcattcaggtggggatgctggtggtttgacatggagagaaccttgactgtgttttattatttcatggcttgtatgagtgtgactgggtgtgtttctttagggttctgattgccagttattttcatcagtaagtcttgcaaagaatgggattgtcattcttcacttcagcacagttctagtcctgcttctctggagtagggttgttgagtaaggttgcttgggttgtgcattgcacaagggcacatggctgtgaggtgtatcctggcggggggctgtctacctgcagtgaggggcaccttttctgttttgctcaaaggcatgtataagccaatgggtgaccttatttcctgtgtcttcaggtgtgtggcagggggcctggggtggggaggtggggcgagcgagcagtgtgtggaaagccttgttgtcacctgaagcacgccaggtccagattgaccaatggttttctcacttcaggggccaacccacgccccctttctgctgaggtttgggtgccatctagtggtgggatgggacttggttgactacatttaaggtaaggtggacccagcaactcccagaaacaactccggggacaccactccccatcacactccacaccgagcctggtgcccggtctgtgcccgagctcagcgggaccaggaagggatgggccctgccagggttgcccctgcactgtgcattctcgcctgggaggcacaagttctttcatctgcttttccttcagaggtgctgagcccacgccatagcccctgtgggatggtgggggagggggcgacccgaacaacagtgcagtcggtatcgagattggggagaggagcgagtccaaggagaaagtcatgagtttctttttactcgtgttgaataataacaataacaataacaataacaatatggaaaccaccgcaaacttggagaaaagttgtaagcacagtaaagagaagcttccttctgagtcagttgagtggttgccgttctggccctgcaccctctgtgctttgggacggcgtccaacccgcattcatgtcaggagtgagtcgcacgtggctttgtggtcatggcgacttaatccgcctggacggtggctccgtctccctgggcttagacgaccttggcacttctggagataagcccatggctcccaggttgtgttcatgtgacgtttccttgtggtaggttctgggtctgcgttttgtctaggagtgtcacaggatggacactgcctcctggcaggggctgcccaatgcagttagcctcctgctggtgttctctcttgttgcttggtgaaggtggccctggtcagcttctccactgcccagtgaacgacccctttgtaatgaatgagtggggaggtagtgtgaagcgatgccaatatcccatccctgtcaaactgcctttactttttccttccttccttgctcccacctgtgtggatcctggtcccttcttgtattcagggctgtggtctgttatgacatttactctcaggctcaggtcctgcttgtttggcccgtgggagccccttcttctgccttttgtgttttttttgttatgtacctacagttctttagctgtttctttactttctggtgcaaaaagatgttcaagccttattttatacttgcctgcccctttctctttcatttattggagtgagctgcagctctaagaagacctgttcttttgaatggagagtagcatcaggaaccaggatgtgggtgcgaggcgtgctcctggctgttgcagattgctgcacccgggagctctgagtggacagagctagaggatatgtgcacgtacttccatctctctctctgtctcatctattcacagctgggaatgatactaatacctccgattttagcccagcaccacagggtacgttccagtttttctctctttccatagctgtaaggccctttctgggaatggttctcattctccttaatctattattgggtcagttttcctgcatgtccccagcctcccatcactgccacccactccccacaagagatgccctgctcatccgactggggctttgactcccacactgtgtacccctcttgtgtggacgccctgctgccaaaaccttcagcaaacagctttccaaatggaagttgtcactgtcagggcctttacaatcagcaacagcaaaatctacatgctgctgagggtcctgcctcattaagatgcaataaatatgtaagtacataaaaacagcaatagaagaaacgtaatgcttttttctcaaatatgatgtctacatagaaaagccaaaattattaagaatagtaagaattcacccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccagcctgggcgacagagcgagactccgtctcaaaaaaaaaaaaaaaaaaaaaaaagaattcagcacagttgtttgctatgagatttaaaaagtttttactttattacttattcatttatttattttagggtcttgctctgttacccaggctggagtgcagtggtgtgatcatggctcactgcagcctccaacttgtgggctcaagcagtcctcctaccttggcctcctgagtagctgtaactacaggcacatgccaccaggtctggctaattgttttatttcttgtagagatggagtatctctatgttgcccaggctattcttgaattcctaggctcaagtgatcctcccaccttggcctcccaaagtgctgagattacaggtgtgagtcactgcacctggcctgccctgagattatatactgaaatcaattgcttttctagacactagcaataagcttataaattatattcaaggattcagttatattcattttttaaaagatatttaaataagattaaaaattcttaaagtttctaaaaataaatggaaggaaagatattcaaggcctatatacagaaaactataaaacttcattaaagcccatgactgtagatacaagtaaattgagactatgtagttttctgttgctgtttaacaagtccccacatacttggtagcttatcacaacctcatttcttagctccaagctgcaggtcagacatccaggcacggcttggtaggtcctccgttcagcagaaattggggtgtcagtgggctgggttccttctgggagctccggggaagagtctgctcccatactcacttgggttgttggccaaatgcagttgcttgcaggtgttgggctgatgtccgtttcctgctggctgtcagccaggggctgctcttagggactagaggccacccacattccttgccatagggtcccctccatcttcaaagtcagcaacaaagaagctgcctcacattgactcccactcgccctttgaatctctaggaaaagcctgtgtggtttacagtttcacctgattaggtcagacccaccaggacaactgcccatccttaaaagtcctgtgtgccacctaacatatcccaattccgggagtgacttattcacgggaggagattatgtaagggtaaggatcactggggtcatcttggaattctggccaccacagtttttctatcttcatggtcaaaaagaattgatattgtaaaaatgtcagccttctccaatttcatccatacattcattataattctaaacataatgccatttttttcccacaaaatttgataagttgattgaaaaattaacatgaaagtacaaaaacaagagcaaaaatcctttctgtgggagaatccagttgagggaattgctgctccattattcctgacttacattgctgggacagcagccacagcagtgtggtcctggtgcaggagctaatcggctaaggggagagagcccggaagccacgcacaccggcgcaaggggcggataggctaaggggagagagcccgggagccccgcacaccggcgcaagggtgaatctactaaggggagagagcccgggagccccgcacaccggcgcaaggggcggatcggctaaggggagagagcccgggagccctgcacaaatgcggaactgcgacggatggcagcaaacccgcagggaagggatggttatttaataaatgctgccagaaattccagcccaggtgggaaaagaaagaaataagttccctgtttcacacctaacacaaaagtacataccgactggaggcgggcttaagtgtgaaaagcaagttttagaacgtttagaagatgaactcaatatatttaaattaagaacttctttctttaaaaaaggccataaaataggcaagccacacactgggagaagattttggtaactgagaacaactaagaacttatatccagaccacataaagagtacctacaaattaggaagaaaaagacaaagcagtagaaagttgggcttttcacagaaaagcaaacacccgggttccatagctatgtcaaaagttgctccgtcttactagttattaggaatatgcaaaatgaaactgaaacacaacatttcactcactccatggtcaaaatggaagaggttggaccatcttaattgttagtacttacatgtttattctgaagagtcaagctaagctgaaacaaccgctttggaaaattgtttggtgtcatttcttgcaattgaataggacataccttggtaattctctgctagatacactcacaagagaaaccgctgcccgtgtgcactggaagacggtcggcagagtgatcctaagagcagtatcagtactagcaacacatctgccagctgaaacgtcctcaacagaatgacaggtacgctgcagcttggtgacagtggagtattacacggccgtgaacatgaatgaactccagctgcaaagagctacctggaagaatcttagaaacataatgttgggtgaacaagttccagaagtctccacacggcaccgtattattcatgtaaaattcaaaagcaaggttaaacaacataccatgtaggcacgcatacatcagtgatgaggttacttcaacacaagacagcctgaagcctgtggtccagtcagtgctgagattacttcaacacaagactcccagaagcctatggtctggtcagtgctgagattacttcaacacaagacgcccagaagcctatggtccggtcagtgctgagattacttcaacacaagacggccag

SEQ ID NO: 24 - DNA, 28002 bp, Homo sapiens
  unsure (4713), (26789), (26794), (26796), (26798),: Identity of nucleotide sequences at the above locations are unknown.
gattctgatccttccacgctgtggtgaagactggcggcgcgggccgcagcaccgctcgctccctccgctgacgggaaaaatgagtccccgcagcgtccgagccccccgcccccaaccggccgccgccgccgccgtcgcgccccccgcgcccccggcctcggctcgctgcgcccccggcgcccgcccccgcgccccgccacccggggcctcacctcgcctcgcgcacggccgcccgtacgaaaaccgtccgccggcttcaggactccgcgtcccaggtccgtgcgccgcgcggtgccgcctccggttcccgggcgtcctcacctcatcgccccgctgccctgccgcccgcaccgccgccgcgtcgccgcccccggtgagccgcctggaccccgcccgggcacggtggaaggatacgaaaagaaggccgcggcctcgacggcggagggacaccgtgcggcgcagctgccacagtgtgcgcgcgcctcccgccaggcccagccgccgcggcgcttccacggggctctgtgcgggacgcgggcacgcgcggggagcgagttctgtgccgggcgctcccgacggcggagggacaaagggcgattcagagcgagccgtcgcctcccctcgtggcggagggattcgcggccggccggtaggcggctgggatccctccgccctcgctgccctttaaatcgcggctgaggcggcgtcgcccgcgccccgcgggcgccacgttagggtcccctgcggcccttacgcgaccgcattccggtcccggtccccgcgggaccgcggcagctgtcccgggccctgggtctttgcacacctgcccctaccagggacggctctagagccagcctctcggactgcagccctcgggaaggggaccccccccccctcccgccgcgcgtcccagttgctccgagggaggtggccccgggcagacgagcttttttgttgtgggaatgggggtcactggcagcagaggcaccctaagacagtgtgggcaggctgagcgttcctgcgcggagcatgcgagggaggaggagaagcgggcgcgccttggcctggccccccgcgggccccgccgcccccagcacccaatatgtgccccgcgccgtgctccgctccactccgggtgtgccatgcgcgctggccgtgcgatccctcctcggggatcccgggctggcggggagatcctgagggaccgggccgcctgcgagccggggagctgcgaagcttgcctgggcatcgatcttgtagtccagacaacagaacgatgagcgcgctcccggcccctgcggggctgcccagggtctccgcgcatcctccctctcacgcgtcaggacgacccccggaggtgggggccatgtgggtgccactttacacctagggaaactgaggcacagggagttccgtgacctctatgacaactagtcagggcttgagccagagccctcattcagcattcgggtgaaaaatgcagaataaatcaggaagcgggtgcggaggacctccaagaagttgaggttggcataggcgtgcacatgcctggaacttggtgccggcaggtgcccaaggaagcgcagacctggagtgtgaattggagcgtgttggggaaagggggtgcctaggatatgggcgggtagtgggaccagccagtgtcaaagccctgggaggggagagaggctgcccttgccacagagaggaggcgggcagggcaggcagctcagtcagatgccaggaagagccgcagcctgccttagttttcccctgcggctccagggccatcatcctccacaaaggatgatgaatcgaggctgtggacgaccacccaacacaagaactggactaagtccaagtaacactgacgcacagcgcctccctcgtttgccctcattctcgaccttgactttggctggtagacatgatgctcattaccgccttccacagagggaaactgaggcacggtgactcgctgagggcacatggctgacggaggcagaagcgggtctcatcttcaaaacagagctcctcccactgccttcacctgccctatcagcagcttcctccttttggaggccgattcgggtgtgggcggtgggcacagcccaagcacttctcctgtctgccctttcactaaaagcagcgtcatctgtggcagcagaatccactctgccacgttcgtctttgcagacgcaactaacaaatgattgctttggtgttcttggtttctggtttatcataaactttccaagattttcgtagtgcctggctccaaatactcaacttgcaccccagaaacactgagcctgcctttgccacccaccaccaccgaatgcctatgggaggcgagctcactaggggaataccatctgcctctaagtcgaccttggtctcaggtcccaagtccagctatgcctgagcagccctccagagcccccaaagccgatgtcctgcccactcccagctttccagagcccaccccagcatagaggtgctctccatgtgcccttcagggtgaacgccaaatcctgagtcctgtgaagcccccgtacttccaagatgcagacacttccatgtgttcactgcctgatgccaagtcaagtgttctggacatttccttgcaaggctgggcccacagcctggcagggatacagatgagcaaacccaagcccagcctgctcccaggcccccagttctgtgtgcattcctccctcaatccccctacgttgccagctgctcttccagcctcagctgagaggcccagggtgggccagggctcctggcagagctgaattggggttcaggaccttggtggagccatgcagggggcttgaggcctttgggggtccccactcagggaagccagggctaggctgggctgagagcacagcccaggagagcccttcctagggagactcccacaggagaggccagttggaggctcctcctgccagctggcaggggagggagagcaggaagtaggcagccaggcacctgcccagtcctgtgtgtcaggagcctttggcatttacactgggagagctctacgcaccccaaagtggaagagatgagccacagaggctggggggcctccccagcctggccggaccaaaagggattaacagctctaaagaaagaccgagtcagcggaaggggcccggctggccccggaagcaccgtgaggctggccaggagtgccagcctagcccggagctggcttaggagtggcacgcttgccagggcactgactgaggccatggagtctattttggtctctctagcaggtctggctctggtgtgtccaggggcactccagcctagtgccacccaccctgctatgctctctcgctccctttcctcgagtgccaggttcactcagtgacaggatggcagggattcacttgctttgatcctgtgcttactgggatggcccacaggtcacgttgaccccagaattccaggctggaggcaggttgcttttcattgtaaagcgatatgttggctttcgtgctccgcacatgcgtctgccccagtccccaccccgcccggaagctaggactcctctgatgggagcaggtgtctgaaaccggagggagagtggggcgtacccggctttcccagtggcccctctgggcggctggcgggtttcctggtcacattcctgagcaccactacccccggcaccattcttgctttccacctgcccctccactgccactgtccttgaatagaagaagaaacagccactgaagccgggcgtggtggctcacgcctataatcccagcgctttgggaggccaaggtgggcatatcacctgagctcaggagtttgagaacaatctggccaacatggtgaaaccccgtctctactaaaaatacaaaaataactggacgtggtggcgcatgcctgtaatcccagctactcaggaggctgaggcaggagaatggcttgaacccggaaggtagaagttgcagtgagccgagatcatgccagtacactccagcctgttttttgagactctgtctcaaaaaaaagaaaaaagaaaaagaaacagccactgaaaggtcaagtgacacacacgagacccctggtcaacagcagcaagactgtacagcagctgccaacagaggttggcacgagtctgacctgggtttgaatcctagctctgcagtttaccagccatgggatttgggacaaatgatgtagcctgtcagcccaccattcctttacctgtgaaaatgtccattccttggacctgtcttagtaagttcctctatagctttacaattgtttatgtgcttcagatgctcaaattctctctccagcctggacttctctgaacttcagacaacactacttcgatgcttaataggcatttcaaatataacacggctaacctgggggacacacgaaagcaaaaccctctcctcacacacccttccacctcttcaaacaggtaccgttccaccactcaggtccaggtccaggacatagttttctttttttttttctttctttctttttttttttttgagacggagtttcactcttgtcgcccaggctggagtacagtggtgcactgtcggctcactgccacctccacctcccaggttcaagcagttctcctgcctcagcctcctgagtagctgggattacaggcgtgtgccaccgcgcccggctaacgtttgtatttttagtaaaaatggagtnttgccatgttagctaggccagtctcgaactcctgatctcaggtgatccgcctgccttggcctcccaaagtgctgggattacaggcgtgagcctccatgcccggccaagacctagttttcattcttcctttgtggcttcagggttctttctccttagcacatacgacagctctagcattctgtatctttcagtattcatcctagggctgactctccttttagactatcagcttctcaagggcagggagctttgtctgtctcattcattgctgtgtcttcagcatctggaaccacccctggggacagagtgttgaggcttctatgcttttgctgaagggagggagggaggaagagggaaagataatactaactttccagggttgctacaaggataaagggaggtgcaaggggctctgtaatcactccccaaattctgggggctcaatcttgctttgttgacaaggcttctccaccacccaccccacaagatgtgtagcgttccagctcacgggtgccctgggggttgtgtgctcagcacccacctggggcagtgggacaggcaccaagaaaatttccctgtcactgaggatgttgttcctttgggatcccatcacacaccttttcatctcccctcccccaaataaaactcagccctaaccagccctctctagaagcaaacacagagaggactgacagcagctggcaaaggtttcctcatgggcacggggagctttgtttttttattattactattattttttaataatttctggccaggtgtggtggttcacacttgtaatcccagcactttgagaggccgaggtgggcggatcacttgaggtcaggagtttgagaccagcttggccaacatggagaaaccccctctctaccaaaaatacaaaaactagctaggtgtggtggcatgtgcctgtagttccagctacttgggaggctgaggcacaagaatcgcttgaactcaggaggcagaggttgcggtgaaccgagatcatgccactgcactccagcctgggtgacagagcgagactccatctcaaaaaaaaaaaaaagaaacaaaatcaaaaaaatgagatgttacaactgaagcagttttgatttaacccattatgggtgatgtccacttgggttacccgtcatgtggtttaggggtgtccaggcttccccatcgtcaggtcacttgcttgcccattgtcataaataagtttgctgtggagaggttcactgaggggatgtgaacatcattcctcaccacattttatatatatacacacacacacacacacacacacacacacacacatatatatatatatattctggtatatatatatatattctggtttatatatatatattctggtatatatatatattctggtatatatatattctggtatatatatatgtgtatatatatgtatatatatgtatatatatatgtgtatatatgtatatatatatgtgtgtgtatatatgtatatatatgtgtatatgtgtatatatatgtgtatatatatgtatatatgtatatatatatgtgtatatatatatatcagaatggatttttgggttcctagttttgttcatttggtgtctgttccttcctctctcctcttcttcttccaccctttctttcttcctcttctctttctctatttatttctctctttccctcccactctctttatttcctcctttacagttatttgtggtagctttatttatagtagctgtaaactggaaacaacccaaatgccaaccaccaaaagaatgggtagacaaattgtggtctctccatgtgatagaatcctgttcagaaataaaaaggaacggaccactgttacaaacaccatagatgaatttcagaaacattacattgagacaaagacgtcagaaaccatagagtaaaaattgctgggttccaacaatgaggtcgtggaagagaaaaatcccctaatctatggtgatagaagtccaaggggtcattagcttctggcagctgggattgcccatgaggggacatgagaaactgtggtgagatggaaatctctgtttctgagggctgattgccagggtgtgtatgttgtgaaaattctcaaactgtaaatctaagttctttttttttcttttctttgagatagagtctcactcttccacccaggctggaatacagtggtgtgatctcactccctgcagcctcgacctctctgggcttaggtgatcctcccatttcagccacctcagtagctgggactgcaggcactcaccaccacacccagctaattttttttttttttggagatggtgtcttgctctgttgcccaagctggagtgcagtggcacaatctcagctcactgcgacctctgcctcccaggttcaagtgatccttctgcctcagcccccctagtagctgggattacaggtacgtgccaccatgcccggctaatttttatatttttagtagagacggggtttcgccatgttgtccagcctggtctcaaactcctgacctcagatgatccacctgcctcagccttccaaagtgctgggattacaggcgtgagccactgtgcccagcaacacccagctaatttttttgaaatttttttgtagagatggggtttcaccatgttgtccaggctggtcttgaactcctgagctcaagcaatccccccgcctcggcctcccaaagctctgtgattacaggcgtgagccaaatctaaaatctgtgcaaatcactgctgcaaattatgcactcaaaaaagagggaaataatctggagaaatgctactgctcaatgaaaacttcagtttttctatgacttatcttgacaagcaaattctataaaatagttttttctcgggtgtttcccagacattgcttctgagaagacccaggttcatggtacaggttccaggtttaaggtgcagatgaggaacctgaagaatcttgttccttcagccgaagcactgttggtgccaattattgctgcagatatttaaagggaggaggcgagctagtcgtggtggctcacgcctgtaatcccagcactttgggaggccgaggcaggtggatcgcatgaggcgaggagtttgagaccagcctggccaacatggcgaaaccccgactctactaaaaaatacacacacacacacacacacacacacacacacacacacacacacacaaactagctaggcatggtggtgtacacctgtaatcccagctactcaggaggctgatgcaggagaattgcttgaatctgggaggcggtggttgcagcgagccgagatcgcaccattggactccagtctgggtgacagagtgagactcagtctcaataaataaataaataaataaaaaagggaggaagagaaactgtccctgcttctaatagacgtgctggaaccttctaccagcatgcgagcctccctgctgcaggcccctccagtcacctcccagctgctgcctggtctgtgctgatctggaagcctccagccaatgctgagttgacctgggtcttctctggccggggtatgtgtggtttatgtggaatcagccaattttgctctgtctcataatcattcccttacattacgcctcatagacacactttggggtattggcttgtcccttgataaattccaaggggtggcatttcctgagccaaaagtccagatggttttcctctagggcattctgggtggccatgcagagagggtgactgggggcctcagccctgcatgctcagtgcacagggcttcccaggcgggggccattagagacctagaagctccctcaccatggggactgagggacttaggctgtctctccatatggtggtcaatgggtgtcaacttgactgggccatgggacacccagatagctgcgtaaacaagatttctgggcatgtctgtgagggtgtctccggaagagattagcctttgaatcgggtggactgagtcaagcagatgcccgtcccccccagtgtggggggcctcatccaacccactgggggctcaaatagaacactaggacttcaacatatgaatttggggaggggagggcacaaacattcagtctatagcagaaagggaaaggggagagaaagagtatagtttaatttttaaaccctccctggaagtgagaaaaattaattacagcaaagaagagaaagccaagagttaaaattccaaatctaaacaggctgccaggggttaggcaggggaagtgctggacacagggcccgtgctagaaaagcacagttattggccgggcacggtggctcacgcctgtaatcccagcactttgggaagccgaggagggtggatcacgaggtcaggagatcgagaccatcctggctaaaacggtgaaatcccatctctactaaaaatacaaaaaattagctgggtgtggtggcgggcacctgtagtcccagctactcgggaggctgagtcaggagaatggcatgaacctgggaggcggaggcggaggcggaggttgcagtgagccaagatcacgcccctgcactctagcctggccaacagtgcaagaaaaaaacaaaacaaaacagaaaagcacagttattgtggccaccccatcaggggttctctgactctcaaaaccaggccctttccatggggaccagttgctgctgggggcaggagaggcagaagtccctggcccctggcctctggcccctgttacaccttctgcctcctgtgtttccttcttattccttctgggaacagagtttctaataataaaatatatcttaaaggcaaaggtactccggtaggagagggaccagggcttggttcaggcctgcattctgcaaacaattgctttcttaataaaaataacaggccaggcgaggtggctcacacctgtaatcccagcactttgggaggccaaggcgggtggatcacctgaggtcaggagttggtgaccagcctgactaatatggtgaaacctcatctctactaaaaatacaaaaattagccaggcgtggtgatgcatgcctgtaatcccagatactcgggaggctgaggcaggagaatcacttgaacccgggaggcggaggttgtggtgagccgagatcacgccattgcactccagcctgggcaacaggagcaaaactctgtctcaaaaaaaaagaaaaaagaaaaataataacgccacacacacacatgttcgtattgtttttcacaacagccaaaaggtgtacacaacccaagtgcccatcagtggatgaggcgtaaacaaaatacaatacacccaaagcatggaagagtattcagccttaaaaaggaagggaattccaacatgtgctacaacgtggaagcatcttgaggacattaggctgagtgaaatgagccagacatagagcacgaaaccgtgtgattgctcttatgtgaggtatgtagggtagtcgtattcacagaaacagaaagtagaatggtgggtgccaggggctggggaggaggaaatggagagttgtttaatggggacagtttcaattttgtaagatgaaaagagttgtgtggataaagtaatgatgactgtagctcaactatgtgaatgtgcttaataccactgaactatacacttaaaaatgattgaggccaggcacggtggctcatgcctgtaatgccagcactttgggaggcagagacaggcagatcacttgaggttaggagttccagaccagcctggccaacatgatgaaaccccatctctactaaaaatacaaaaattagctgggcgtggtggcgggcacctgtagtctcagctactcgagagactgaagtgggagaatcacttgaacctggggcgggtggaggttgcagtgagccgagatcacaccactgcatgccagcctgggtgataaagtgagactccatctcaaaaaaaaaaaaaaaaaaagactgagatgacaaattttacattatgtgcattttcgcatagtttttttttttttaaaaaacaaaacagcagccagttcactgaatttccaccatgtgccatgactgggtaaggctctgatagagaacattgtgatctgcatttatagatggggaaactgaggctcggagtggcttacccagggccacacagccttagtggcagagctagtgcgctgacccctctgttgtgcggctgaggtgtgagagtgccccccggcgctgcatgagccgccagggctatgactccaacctcctttgaaggaggacactcttagaatctcatctgggacctcaatttttagcatattctgtcctcttgttgcagaagatggggtccttttattttattttacttttttgagggacggagtctcactctgttggccaggctggagtgcagtggtaccacctcagctcactgcaacctccacccccgcagattcaagcaatttttgtatttttagtggagatggggttccgccacgttggccaggctggtctcgaactcctaacctcaggcaatccgcccatctcggcctcccaaagtgctgagattataggcgtgagccgccgagccctgccagatggggtccttttaaatgctgtcctgggggctttctggccattgcattcttttgtgagttaagagtcggctgctgagtctgccgtccagtctttggcgtcagctcactactgccatgctctccaccatcctggtggctactgttgcctccatgccactcaggtgcaggagcagctcaggcccgtgcacctttcccacctatgtgccacctcaacacgtgagcatcttagcattgtgacgctacagcgggctgcagcgatcgccactttgctcctcagcagcaggcacccggtgaccctctggctggcaaatgagcccttcttaagggactgcttcctaggcccacctctgataccagctgtctcaggctgggtcctctagaagcagaccccgagaatatgatttgacaatgagtcctttatttgagaagtgatcccaggaagcaccagttggggagcaggtgagacggggatggggaagaagccagaagagatggtgcattcataatccggttactgctgcaggctcaattctgctgggatcctccaggcaactgtgaggatgtgcttcagtgttctccaactgaggcaagagagctggggtattgatccaccacttctgccagtcatgggattagggaagctccctgggattgcaggcttgtgcagccagggagtgccctcgagttaaggcacagatgcttacagctggaagggttgggggcatggaatagtgggggctgaagggaagtggatgggcattgtcaatgtctgcaataaagcagaaaaactactgttaaacttctttacatttagagccctactcttctgaacccttctcaactcagtcatcgacatccataatttttcaatccacactctttctgccatcatgaatgttgatggtacagcatttctcaagagtgattgttccaggctgggttcccaggaggctgactctgaggcagaggacatgcaggaagttggttagaggctgctcttgggatcaacgcctttggaagagaatggaatggaggcaagcaggactgggctgagggagaagctggcctgggatgccagcccccgtggggagctctgaagatgaggtagcccttgcacttccatgccaggctgtcctgggaagggagcatgtcatggggtgggcagcctgcatcagctgaggccgtccctgaagggggccacctgccaaaagcattgcagcagctggccaatgggcctcccactcctaagggtgaatgtgagcagtgcaggagagcatccgccacagtcctcccctttactgcttggatctgcttctccacgtccaggatggccgctcccttttctgcccggggaccttctctggccacaagggagcaggcacaacccagccttgcccaggaggtgatgctgtgggcagccgacagataacccatcagcttcacctctgtgggatgactcctgggtgagttccatgtggttcctcaggcagtcactggcaggagagagccctactcacccccagtggcgagacctacttgttaaagcactttctggaactttctcctcccctgcctagttcctcacttcctggaatacctgcttgccctcgaacccttgttgcagggtctgcttttgagggaactccaaccaagatgggcccaatgcagacgaagaggctgaaaataaaggagagtgtgcagggaggagcagggtccccaggaggcctaggaggctgacggcgttgggcgttcagagggagagctgcgttaggcaggaggggcaagggtgtcacttgcggggtaaacatggacacttctgggggtgggccgcaggtggatgaggaagttgctttctgattgcatctggtttctctgtgaggaaggaggcgaggtgagagtgagggtggctgaggaggagataaacaacttgaggagagtggagaaggccccgacggagaaggagagagcagcctaggaaaatggagacgcccttcccaaagggttgggagtcaggggcctgggggaccgtgagcttctggaaccagctgcaccaccgtgagaccgtctccgtcaacactcagcatccctgtggaggggctgcatgcagagagggttggactagacacctttcatggggtctgcccgattcactaccttttcatctctaccaaccatgccctcagcctccacaggggttatttctggtacaactctgctcccaagcccaggggtggtcattggatccaagtttagctaatccctgtcccagggagagtcttgttctcaatttcaaccaacattactatgcccctgtggtgagctgggccctgggaaaacagcggtggataacagacaagacccctgtcctcatggagcatacagcccaagaggggtgatgcacaataaccaaataaacaaagagtccaaagaattaggggtcgagcatggtgggtcacacctgtaatcccagcactttgggaggctgaagtgggcagatcacctgaggtcaggagttcaagaccagtctggccaacatgatgaaatcccatctctactaaaaacacaaaaattagccgggcatggtggtgtgcacctgtaatcccagctactcgggaggctgaggcaggagaatcacttgaatccgggaggcagagcttgcagtgagctgagatcacaccactgcactccagcctgggtgacagagcgagactctgtctcaaaaacaaacaaaaacaaaaacaaaataacaaaagaattagggactgtgacaaggaggatgagagaagtaagctggctgccgagacggtgaatggcacctccattagatggagtggctgatgtcaaactctccaagcagatgacacgcaagctgagacctaacaggtgagaaagaccgaggcatgccaaggacttgagtcaaagtatcccaagcagaaggacgagtaaatgcagaggtgagaaagagattggtgtgttctcctggggagtgccaggagaccgcgggtgctggagcatggtgagcaagaaatgaagttggagaaaaggcagaagctggaacacgtgggagcctctcagtttttgctaaagactttggattttattccaagtataacaagaagccaggagtgacacagtcctgtttttggggtaatgttttatttttgtataattccaaacttacagaaaaaaagactagtataagaaactcccatatatacattattcaaattcgccaactatttacactctccctcttcacagtagttacacagttgctgcaaatactggatcattgcttttaggggaagacagggtcaggttcctgtgagcctccggctacaacattttcatcgactgatcaatacatgaccttttcaaaaaaaaagtgtgcttttgtttaaagacaccttatttataggccgggcgcggtggctcacgcctgtaatcccagcactttgggaggccgaggcgggcggatcacgaggtcaggagatcgagaccatcctggctaacacggtgaaaccctgtctctaataaaaatacaaaaaaattggccgggcgtggtggggcgtgcctgtagtcccagctattcgggaggctgaggcaggagaatggcgtgaacccaggcggcggagcttgcagtgagccgagatagagccattgcactccagcctgggcgacagagcgagactccgtctcaaaaaaaaaaaaaaaaagacaccttatttatttattattattattatttgagacagagtctcactctgtcgcccaggctggagtgcagtgtcaccatcttgactcactgcaacccccatctcctggattcaagtgattctcttgcctcagcctcctgagtaggtgggattacaggtgtgtgccacaacaccagctaatttttgtatttttagtagagacagggtttcgctatgttggccaggctggtctcgaactcccgacctcaggtgatccacatgcctcggcctcccaaagtgctgagattacaggtgtgagcccctgtgcccggcctaaatacaccttatttaatacatattgttgatccattgacattgaccccacgtggccgtgggggtcaatgagcgctaaaactctgcctgaatgaagcttatctaactcgggcattttctcccaaaggcacgcatagccttctcgatcatgggaacactagacagcctcagcactgcacgggggccattttgaatggtgaaatcaccaacaagaagcacaaaactgtgaaaaacatgacactaaatagactgtgaaaaggacacttgtttacgggtcggagagctgaaacagggagatgagtgctgactgcttcacctcagcgggtgactttagtctctggagacatcaatttttcaccactctgtgtatgcaccggctttcaaatacccacagaaaggcccaagtattgattttggggttacaaataaatttagctagaggtgaacccacaaatacagaatccaagaataatgaagatgatttgaatcgtgaggttatgttagaaacaccccacctctgcacccctgagtacttcagtgtatatttccaaaatggttgttctcttacataatcacttttgtagttgtcagaatctggaaactcaccagcaatacaatactataatttgatacatgcttttcccccagtccagcagccagtccaagatcacaggatgtgtttagttgtcctgtcttttggtgcctcagtcttgctttgctttttgtggtcttgacttgcagaatgtccttctgtgtgtgttatctgatgtttccttgtgagtagattcaagttgtgcgtttgtggcaagaatatccaggggtgatgtcttctcagtgcataaggagagatgtactgctgttattttgctatttgtcctctgtttgcttcctagcttttctggacctcatttcctgcattacaagctttttggtgtgtttggtttttttttttaatagaaaaatgtttgaatttcttctcattttcttctgtgtatattctacagctattttctttgttattacaatgggtattacatttaacatctgtattagtccattctcatgctgctaacaaagacatacccgagactgggtaatttataaaggaaagaggcttaattgactcacacttcaccatggctggggaggcctcaggaaacttacagtcatgggtggaaggggaagcaaacatgtccttcttcacatgccaacagtaaggagaagtgctgagcaaaagggggaaagtccccttataaaaccatcagatctcatgagaactcactcactatcatgagaacagcaactttgaggtaatgacccccatgattcaattactttccaccaggcccctcccatgacaaatggggattgtaggaactacaattcaagatgatatttgggtggggacacagccaaaccatatcaacatcctaaagttataacactctggtttgaatttataccaggtcaacttcagtatcgtataaaaactctgctctttttacagctccatctctttttcttatggttgttgatgtcataaaattatatctttaaacattctatgccccaaaacataaactgacaatgatttttaaaaagttagtgtcttaaattatacagcaaacaaaatgtgtagttacaaaccagttacagtaatactagcgttggattagttcttggtttaactaatcaattaattaatttattattatactgacttttaatttattttatttacttatttatttattttgagatggagtctgtctcactcttgtcacccaggctggagtgcagtggcccgatcttggctcacagaaacctccgcctcccaggttcaagcgattttcctgccttagcctcccaagtagctgggattacaggcacccaccaccatgcctggctaatttttgtatttttagtagagacaggattttaccatgttggccaggctggtcttgaactcctgacctcagatgatctgcctgcctcggcctccaaaagtgctgagattacagatgtgagccactgcacccggccgatactgattgttttttaaagtgtaatagtctcttaaattctgcagaaaaccaaaagtagttttacaacctactgttacaatagtactagcttttataattgcacatatatttgcctctattgagatctttacttcttcatacagtttcatgttactatctagtgtcctttcgtttcaccttcaggactcccttaagcatatcttgcagagcaggtttactggttatgaacttcttgagttttcttcttcgctttttttttctttttctttcttctttttgttcagagacagggcctcactctgtcacccaggatggagtacagtagcatgatcacagttcactgcaacctcaacctcctgggctcaagcaatcctcctccctcagcctcctgagtagctaggattacaaacatgcatcacaacgcctgacctttgattttgtagagatagggtctcactatgttgcccaggctggtctcaaaatcctggactcaagtgatcttcctgccttgtcctccaaagtattgggattataggtatgagctattgtacctggcccctttggcttttcttatatttttcttttatcttcttaaaaatattatttatgggttgggtatggtggctcatgcctgtaatcctaacactctgagaggccaaagtgggcagattgcttgagcccaggagttggagaccaccctggacaacatggagaaaccccactctacaaaaaagaaaaaaaaaattagctgggcttggtgcatgtctgtagtcccagctgtagtcctcaggaggctgagatgggaggatcacttgagcccaggaggctgaggctgtagtgagctgtgatcatgccgctccactacaacctgggcgacacagcaagaccttgtctcaaaaaattttatattattgattcctttcttttacaaacccttatcttgagggctgactttaaatagatcacagtgagggagatactctgctatgtacaaaatcctgacccagaagcaggttgtctatgaatggtttagtaccaggttctccgtgaatgtgcactccatgatgggccagcggggacagcccatttctggccataccccatttcacgggttgaggagttctctgtactggactccggtcctggcaccagatgaggcactggcagcacggtaaaggaccagctatctgaggccaaccaaggctctgcagtgctatcatatcattctgccttctgcctgggcggagttttgatttagaggcattcagtcataatctcacggatggaagctttgctgcattggcttttcagccaagcacatattcttcacttttgaaagacagttttatccaatataggattcttggttgacaggttttttgtttttgtttttgtttgtttattttttatttttttgagaccgagtctcactctgtctccaggctggagtgcaatgacatgatctcagctcactgcaacctctgcctcctgggttcaagcgattctcctgcctcagcctcctgggtagctgggattacaggtgcacaccaccaagccctgctaatttttgtatttttagtagatggcattttgccatgttggccgggatggtctcaatctcttgacctcgtgatctgccctcctcagcctcccaaagtgctgggattacaggcgtgagtcaccatgcccggctgtttttttttttcttttaatagtttgaaaatgtcttgggaggccgaggcaggcagatcacaaggtcaggagatagagaccatcctggctaacatggtgaaaccccatctctactaaagatacaaaaatttagccaggcgtggtaatgggcgcctgtattcccagctactcagaaggctgaggcaggagaatggcatgaacctgggaggtggagcttgcagtgagccgagatcaagccattgcactccagcctgggcgacagagcgagactctgtctcaaaaaaaaagaaagaacaaaaaagaaaatgtcagcccactgtcttctggcctgaaaaatttctaatgagaaatctgttgaaaatcttatttaagatcttggtatgtcacatgtctcttctctcttgctactttcagcattctctctttgtctttcaaaagtttaattattattaattattattattattattattttgagaaggagttttgctcttgttgcccaggctggagtgcaatggtggaatttggactcattgcaacctccacctcccaggttcaagcaattctcctgcctctgcctcctgagtagctggaattacaggcatgctccaccatgcccggctaattttttatttttagtagagacagagtttctccatgttggtcaggctagtctcaaactcctgacctcaggtgatccacctgccttggcctcccaaaatgctgggattacaggcatgagccgccgcacctggcctcaaaagtttaattgtaacgtgtcttggtgtgactccttctctctcttaattttaatatttaatttaattttatttatttatttatttatttttgagacagagtctttttgtgtcacccaggctggagtgcagtggcgtgatcttggctcactgcaacctccacctactgggttcaagcgattctcctacctcagtctcctgagtagctgggactgtgggcgcgtgccaccacacctggctaatttttgtacttttagtaaagatggggtttcgccatgttgtccaagctggtcgcgaactcctgacctcaggtgatccacccgcctcggcgtcccagagtgctgggattacaggtgtgagccactgtgcccagccaattgaatttaatttttgagacagggtcttactctgtcacctaggctggagtgcagtggcacaatcatagctcactgtagctttgacctcctgggctcaagcaatcctctcacctcagcttcccaagtagctgggactataggtgtgtgccatctacatctgactaattattttattttttgtagaaacaaggtctcactatgttgcccaagctggtctcaaactcttcagctcaagtgattcttcttctgcctcaccctcccaaaggcatgagccactgattctctctctctctctctctctttggaaacagagtctcactttatcacccaggctggggtgcagtggtgtgatcatagctcactgtagccttgaactcctgggctcaagtgatcctcccacctcagcctcccaagtagctagctaggactacaggtatgcaccacaatgcacagttaatttgtttgtttgtttgtttgtttgtttgtttatatgtttgtttgttagagacagggttttgccatattgcccaggcttgtctcaaactcctgggctcaagccaacctcctgcttcgtcctcccagagcactgggattataggcatgagccactgcatttggttggatctctttgaattcatcttacatgaagttcattaagcttcttgcatgtttcttttcatctctttcatcaaatttcggatatttatggacattaatttttcaaatattctccctgcttctttctcttctctttctgtgactcccacagtgcctatgttggtctacttgatggtatcccaaggtcccttaagctctgttcatttttcttcagtcttttttttttctttctttctgttctttagacttgatcatttccattaccctatcttcaagttcactgattctttcttctgcctgcttaaacctgcctttgaatctgccctctacttatttttcatttcagttgtacttttcagctctggaaatttttttggtttcttttagattttatttttactgatatttccatttcgttcacacatcattctcttgacttactccataccctcctgtagttttctgagcatctttaagacagttgctttaaagcctttttctagtacacctgccataagctctttttcagggacagtttctgtttatttgtggttttctttaaccttcgaataggctatatttttctgtttctttgtatgccttttgatgttttgttgagcattggacaattgaatttcataattgtaactggaaatcatattctcccccttatccagggtttactggtttttgttactatttttgttttttgtttatttgattgattgttgtagcctatctctgtgtcaagaatcagcctggaatgtaaacttaaggtcttctcaggtattttctgagccttgggtacgtgtggtcacttactcattttcctcatatatgcagttttaaaaaaatgttccaggccaggcgcagtggctcacgcctgtaaacccagcactttgggaggccgaggcgggcggatcatgaggtcaggagatcgagaccatcctggccaacatggtgaaaccctgtctctactaaaaatacaaaaataaaatttgctgggcatggtggcgcgcgcctgtagtcccagctactccagagcctgaggcaggagaattgcttgaacctgggaggtggaggttgcagtgagccgagatcgcaccaatgcactccagcctggcgatagagtgagactccatctaaaaagtaaaaaataaataaataaagttttaaaagttctagtgtttaatgtctggctcccaaagggaaataaaaagaaaaatgaaggtggaaggaaagtgcatcagccctttaaatgccccagaagtgacttcagccagagggggaggagcttgcaacaactggaggagatgcagcaacagtggccacctgcgcctctgtgattaggagcaccgctgtgggccaggcacggtggctcacgcctgtaatcccagcactacggaaggctgaggtgggtggatcacttgaggtccggagtttgagactagcctggccaacatggcgaaatcccatctctactaaaaatacaaaaactagctgggcgtggtggtgcacgccggtagtcccagctactcaggaggctgaggcaggagaatcgcttgaacccgggaggtggaggttgcagtgagccgagatcacaccactgcactccagcctgggcgacagagtaagactccctctcaaaaagaaaaaaaaggaagcacctctgagatcagaagcagcactcagcagtgagagcacagatccctggtatttggaggacaggactctttttgcccacgccggctcctgcaagctgtgtgcaggttgctccaggaacacatgcacagctgcgtgccatagggctgggggtcagggatgggtagtagccattgtgggaagagctaaaatggactgaaatttactgtaatttaccagtccaagccttccccctggaagccacaagtcttcaatacactgcagagttctaaaatagttacaccagacagattctgccatgcaattgttgtctaggtggggagacagattcctggtgcttcctaccatgctatcttcccagattcctctctgaataggtgacttataaatttttttttccagtcagtgtcttatcatttcattttcttaacagtgtcttttacagagcaaaaattttggtgaaaacattttgatgaggtctatttcatcaattttttcctttagagaccatgattctggtgtcatagttgtattcttttcctaaaagcctccacctcccgagttcaagctattctcctgcctcagcctctgagtacctgggattacaggcgtgcatcaccatgcatggctaatttttgtattcttagtagagatggggtttcaccttattgaccaggctggtctcgaactcctgacctcaagtgatctgcccaccttggcctcccaaagtgctaagattacaggcatgagccaccgtgcctggcctcttactttttcttctaagagtttcattgttttgttttgtatttaagtctgtgctccatatttcgttaatatttatataaagcttaaggtatagattgaggatctttgtcttcttcttcctttttttgcatactgatgtctagttgcaccatctgttgaaaggttatcttttttttttttttttttttggagacggagtctcgctctgtcgcccaggctgtagtgcagtggcgcgatctcggctcactgcaagcacggcctcctgggttcacgccattctcctgcctcagcctcctgagtagctgggactacaggtgcctgccaccacgcccggctaattttatgtgtgtgtttttttgtttgtttgtttttcttttttttttttagcagagacagggtttcactgtgttagccaggatggtctcgatatcctgatctcatgatccgcccgcctcggcctcccaaagtgctgagattacaggcatgagccaccatgcccggattattctttcttaattgacttaccttttcatgttttttttaaaagcccaagtagtgtctgtgagttctccaatcttctttttctttttcaaatttaactattccatatcctctgtctttccatataagatttaaaattagcttgttaatatctacaaaaatattctgctgagattttgattggaattgaatgaaatctgtagatcaatttgcagagaatttttttttttttttttgagacagagtctctgctgcccaggctggagtgcagtggtgcaatctcggctcactgcgagctccgcctcccaggttcacaccattctcttgactcagcctcccgagtagctgagactacaggtgcccgccaccacgcccggctaattttttgtatttttagtagagacagggtttcaccgtgttagccaggatggtctcgatctcctgacctcgtgatccgcccacctcggcctcccaaagtgctgagattacaggcgggagccaccacgcccggccgagaattgtcatcttaactatgtgtgtgtgtgtgtgtgtgtgtgtgtgtgtgtgtgtgtgtgtgtatctcaagtattccaaaccatgaacacagtatgtctatctgttacttgggtcttgtttgatttatttcatcagcattttgtagtttgcagctttcaatcctatatatacgttgttagattcaaacctaagtagtaagacttttgggagctctgggactggttttgtcattgttttccattactagtgatccctgagggagaggaagcaaatgagatgagccctaatgatggccccatcttactgtctgaagagtttgcagcctgcagcgcaaagaaggaagagctgaggagcagcccggaagctttcctgaagtgaggagatggagctggaggtctgggaggcccagactggagttcacagggcaaagttctagaaagaaaagagtgcaggggaaggagagaaattgagattgtaccctgaagatttagagtcgtaattaatctgagtgccaatcagtgcatacatgtgaggaaaatgctgaggctggggaaggaacctcccaaaaggatcagtggaaacaatcatggcagctcacgtagggccaggaatatttttcctttcccaacttcagagtggaaaccttgtggggcattgagtaaagtactcagaagggttctacctcagtagtggggaaaatgagccctagactaaatgtcgctctggttctacctaacacaacacgaccagaaagactcaaactcttttcaaagaatttaactgtgtcccagaacaaaattcaagataatttatatgaatacaaaaatatcatacaacaaaataattttcaaaactagcacaaatgatgtattgcagccagtaaaaagttgccaggcatgcaaagaagcaagaaactgggagccatcatgaaaagaaaatgttaaatcaattgaaactagaaatgagccagaaatgacacagatgacagtgttagtagacaaggacattaaaatagttattataggctgggcgcggtggctcacgcctgtaatcccagcactttgggagaccaaggtaggtggatcacaaggtcaagagattgagaccatcctggccaacatggtgaaaccccgtttctactaaaaatacaaaaattagctgggtgtggtggtgcctgcttatagtcccagctactcgggaggctgaggcaggagaattgcttgaacctgggaggcagaggttgcagtgagccgagatcatgccactgcactccagcctggcaacagagcgagactgtctcaaaaaaaaaaaaaagttattataactgtattccatatgctaaggaaagtaaaggaaaaattaagaatgttaagtaaagacacagaaatatattttaaatacccaacgtgaacttcaagatattaaaattacaatgtttgagatgaaacatatattgaataggattaacagcagataagacatggcagaagaaggctgggcgtggtggctcacgcctgtaatcccagcactttgggaggccaaggcaagcggatcatgaggtcaggagatcaagaccatcctggctaacacagtgaaaccccgtctctactaaaaaaaaatacaaaaaattagccaggcatggtggcagatgcctgtagccccagctactcaggaggctgaggcaggagaatggcgtgaacccaggaggtggagcttgcagtgagcctagatcgtgccactgcactccaacctgggcaacagagcaagactctgtctcaaaaaaaaaaaaaaaaaaaagacatggcagaagaaaaagttagggaactaagatgtcaaagaaagtgcttcaggcagaaggaaaatgaggccagagaaaagctggaaatacacaaaggaatgcagagcactggaaatggaaactacatggataaatatacatgtatttttttcttattcattacacttatttatcaagtaattttttgactttgtaaattggcaatttataattgtatacatttgtgaagtacaaagtgatgttatgatttatgaatgcaatgtggaaaaattaaatcaagctagttagcgtatgcatcacctcaaatacttaacattttttttgtggtaagaacatttacgttttattctcttagcaattttgaaatataaaatattctattattaaatatattcaccatgctgtgtaatagaactaagaaaaccccatatttttcctctaactgagattttgtacacttcatctccccattctccacagtcccagtctctgtaaccagcctctccgcttctatgagttcaattgttttagattccatacataagtgagaacatgtggcatttgtctttctatgtctggcttatttcacttagcataatgttgtccagttccattcatattgttacaaataacagaatttccttcttttgaatgactgaatagtattccacagtatatatacaccacattttctttgttcatttgttgatggacagttagggtaatttctttctttctttcgctctgnttgtnantnggagacagagttttgctctgtcacccaggctggagtgcagtggtgcagtctcggctcactgcaacctttgcctcctgggttcaagcaattctcatgctttagcttcccagtagctgggattacaggtgtgcaccaccatacccagctaatttttttgtattttagtagagacggggtttcagcatgttgctcaggctggtctcgaactcctgaactcaggcaatccacccaccctggcctctcagagtgctgggattacaggtgtgagccaccacaccaggccagggtgatttcataaactactgtgaatagtgctgcaatgaacatgtaggtgcagacatcccttcaataaactgatttcaaatcttctgggtaaatacccagaagccattgctagatcaggtaagtgattgtttaagcaaaaataataagaatttgctgtggagttcatataaaagtaaatgcatgacaatagcctaaagactggaaaggaaaaaatggaaatatactattgtaagttttgttttgttttgagacagggtctcacttgttgcccaggctggagtgcagtggcacaatcacagctcactgcagctttgactcctgggctcaagcaatcttccttcctcagcctctgaagtagctgggactactggtgtgcaccaccatgcccagctatttttgtattttttgtagagatggggttttgccacattgcccaggccagtcttgaacttctgggatcaagcaatccctttgctttggcctcccaaagcactgggattacaggcacatattagtctgttctcacactgctatcaagatctacctgagactgtgtaatttataaagaaaagaggtttaattgactcactcttccacaggttgtaccagaagcatggctggggaggcctcaggaaatttacaataatggcagaagggcaaatgggaagcaagcatgtcttcacctggcaggatagtaatcaaagggaaatgctacatgctttcaaacaaccagatcttgtgagagctcactatcatgagtacagcaagggagaaatctgcccccatgatccaatcacctcccaccaggtccctccctcaacaatggggattactattcaacatgagatttgggtggggacacagagccaaagtatatcaaggcatgtcttcaccacggggccggcaggaaccgcagtac

SEQ ID NO: 25 - DNA, 132205 bp, Homo sapiens
  unsure (126977): Identity of nucleotide sequences at the above locations are unknown.
tatttaggtgacactatagaatactcaagcttttccaacttgggtatcatccataggaaaaaacattgctgttagcccatggaaaatgggtggccaccaaaaccactgggcagtgacccgcttcctgatgggaagtgtgggaacgaccagaaagggggtgagagaggcatcacagcagcggcagccagggcctcctcatcaggtaccacacacgaatgctcccctggctgccatctgccaacatccgaatgctgtttcgattgccataaagacaccaaacttccacagtctacactctcaggaggaatgaggaatacccaccgctcactcagtctccgtaaggtggcttctgatagatataccaagagcccctcctcgtagaaagatagatcaggattttccaagggtagataagaggcactgccaagccctggagtagcgaagggtggctaacactagttcacatctcacacagatgcagaaagactgaattacttacttgaaattcattttctttctgagcttgttcggatccctctttattacaggacctctatgaatgagaaaaaggaaacacttctggtgagatggggaacactaaacagacactaactttgcaaccaccagaacagtcagggtttacaaaacatcacaggtctttaaggaaggtttctcagcccaccgatgtgacgggcagcatctaatgcaccagcagcctccagcactagtaccaacaccttagaaagtgcttcattgctttacgagaaaagggatgtgccggtgagacccgatagctgcacgtctcacagccgccccatgtacctttcacaatttcattgttagaggaaagtcaatagagtgcactcttccaatcaggccttctaaagacaagcggtcaggctgagtctctcaccaatttagctacgtggttctctcaagtcaacctgcaagaacagggagtgtaaacatgcctgtggacagctgtggtcagcacagaacttggacagagaagaaagcgctgtgcaggcaggaaacctggcacaaaatctgtgcagacatgccctgccgactcgccactttcccagagtaacccctctagttcagccggtcaccagctcaagctgaactgttcctctaccataaagaggactgtgtgtatttaataaagtctctaaaattatttcatatattaatatattaagaaatacttatatcactttcctcaatgaaattgcaaatttatgataaccaggattctagcaataacaacacactagatcattaactaccataaacaacccttgggctacattctttctcatggtacagatcatatattttaagagcaaccccccaccccaaatgctttaaaatccttcgtactatctttaataagggaatggggaaaagtaaagtcagaaacttgtgtcacgtcaaacttttatactcaaatactgcctctaaaaatgttacttgttaaattaaactaagtctgcttaagccagacacaaaaggaatcccagaaaggaaacctctttaaaaaaatttaaggtaacagattcttgaacaccccatgaaaaacatacctttccattccacagctttatcaaaaatacctgtaccaagggtggaaagtgtggacaggaaaaaaaatgccacgttaagcaacaccagctactctagcaccaatcaaaaacctagtgatttaaagcaaccactcatccatcacacactgaaataacattacagacgttttaatgcatgttttgtataaacagtacatgtaatataaaagtaaacaaaataagtatccatgttcataaatctatttgcaaaaggctcttaacgtttgcactgatacatattcaatactatatttagcatacagttaagtacatttggtacaaagtacagaaagtacaaatggggatttatgatattttcatttgtgtaatctgcagttctctgatgaaaagatgttacaggttaaatcccgttacaatgaaagctataaaaatcaaaatactacaaaaatgctttcagatctttgcagatggtttgatgtgcgatgtggtaggcgctggaaagcttcccttcaccctaattccaaacactctcgtggccgcatcgttccttagactctgctttgcgggtcgcctcttccaagcagtctgtaaattcctaatgaatagggactgcgtcttttattgatgttagtcttctcccagagcaccaagcaaatctcgatgcccactacactttttaggctgcatgaataaatgaacactccggagtggtatagcacgaggcaagtgagcccaacgagctgcctggtgccacgcagccaaccagtgatagcaaattcccatccagggtcttggtaacaaggaagctggctgtggggttaattagaaatgccccttcaaaagtccttgtgtttttttctccaaagaaacttaagaacaaaaaagttctataatctgatatattacatattaatactttgcagtataagctttaagacaaataagttagatactcttctgaaattgttgtaacgggatttgacctgtacacaattctaaatgactatggttattcctatgctgttgttactctaactgtatcttcttagggagatacagttaatgggttatttagccttcagaagtccctttcccttatctaatggcgctcgcaaaagcaagttacttcatccaaagttaaaaattggctgaggccccaaagtctttcctttttttaaacatattggcactataagtggtagtaaatccatgataatctcccctgcccactccctcactccacccccagatgaattcatcacttataccataagagcaccattatgaaggcaagatggacttctgcaatatccagccctctgttctgtttcctcagtacagaatgttcaggctccctaagtcctgtaaataagaagtgtaagacgaggaaatctcaaaccaagtgtatattcatggaaaggtaagagaataactttttcgtccaggaagacaggaagttaaatatattttggggccggggggggtggcccatgcctgtaatcccagcactttgggaggctgaggcaggtggatcatctcaggtcaggagcttgagatcagcctggccaacatggtgaaactccaactctactaaaaatacaaaaaaattagccgggcatagtggcgcatgcctgtaatcccagctactcaggaggctgaggcaggagaatcgcttgaatccgggaagaagaggttgtagtgagccaagatcacgccactgcactccagcctgggtgacaagagcaaaactctgactcaaaaaaaaaaaaaaatacatatatacgtatatatacacatatatatacgtatatgtgtatatgtatgtgtatatatatacacatatacgtatatatatgtgtatatatatatacacatatatacgtatatgtgtatatatatacacacatatacgtatatatgtgtatatatatatacacatatatacgtatatatatgtgtgtatatatatataggaatccgtgggattttacttcagtgacataaattcatttgaagtagatattaaaatacattgtataaatatttagtatgacatccaacttttctctaacaagttaataaaaattatcctctataagttataaaacaaaactaagctttttacatttattagaaatttgaacactggttatttaatattaagtaattattaaatttttttaatgtgaacattactgtggtcatttttaaaaaatcatcttatatagatacagactgaaatatttacagaataatataacatctggaatttgcttcaaaataaccctggtggagtaaatgagggaaaagatggaagaagactggctgtgaggggaagatgaggaatggacactggggttcattatactcttctactttagggtatatctgaaattccccataataaaaacttttaaaaaataaacattgaaatttcaagacctaagaaatcagaatgtctcaattatgcctaagacacccaactccataaatacactgaaaaccactgaattctacacttaaaaggcacacaataatgaaaaatatattgccactggcttcctcccaccttctttctttccttcctattttgggcttagttttcaagagaatcttaagttagagtcatatattcattagcctgtgatgtaggaaacaaatgaggctacagtgacagcattaataaaggaggcatacttactattttaaagttagcttttaagaggtgaaactttaaaaaaaaaatttggagactgggtctcgctctgtctctcaggttggagtgcagtggcaggaatagggctcactgcagcctcaacctccccaggtcgagcaatcctcctgtattagcctcccaagtagcaggaccacaggcatgtgccaccatacctagcctttttttttttcttgtagagacaagatctcactatgttacccaggctgctcttgaattcctgagctcaagtgatcctcctgccacagtctcccaaagggctgagattacaggcatgagccaccatgaccagcctgaaaaagattttttgattggccaagaacttttaaatttaaaaactaaattcctgaaagtctgaattatattagctatggagtaaaatgagaaaatagaggactttcatttttactttatttctatactttaaaaagtgcttaaaagcgtgtattatttttataataaatacatttgatacaaggtttcaaatgttacttttctaacaaaattgcaatttaaggctttggggtttttttgtttgttttgttttttgtttttgagacagcgtctcactctgtcacccaggctagagtgcagtggtgcaatctcagctcactgcaacctccacctcctgggttcaagcgattctcccacctcagcctccggaatagttgggattacaggtgtgtgccaccacgcccggctatttaggctttgtattttaaatgagactatgaaaagcagtaaatattcatattacagagcacaggttttcaaaatgttctacttcatgctttaaaaataaaatgggccaggcacggtggctcacgcctgtaatcccaacactttgggaggccgaggcaggcggatcacgaggtcaagagatcgacaccatccttgccaacatggtgaaaccccttctctactaaaaatacaaaaattagctgggtgtggtgatgtgcgcctgtaagtctcagctacttgggaagctgaggcaggagaatcacttgaacccaggaggccgaggttgcagtgagccaagatcgcgccactgcaccccagcctggcgacagcgagactctgtctcataaaataaaaatacaataaaaaaaatcaataagtggtaagacaactccaggaccaaggaggaagagatgtccctttattgtattttgtgttatatgattttaggattcaaaaacctactttaagttacctaatgttccacaatatagcaggtatatttcttttaacctatttaagccatcagacagaataaacttatttggccagtacttaatgaaagacttctctaatactgagggaagtaggtttatgactaaacgaataaagccccatttgggagatgaaaacaaagcagcacctcagttttccctagagtctgtgtatagtaagaatgggtgaaagcggcataaagaaagtgtcattaagtcacatatagttatcatttaaatgtcatttggctgggcgtggtggctcacgcctgtaatcccaacactttgggaggccaagatgggcggatcacgaggtcaggggattgagaccatcctggctgacacagtgaaacaccgtctctactaaaaatacaaaaaattgcctggcgcggtggcgggcgcctgttgtcccagctactcgggaggctgaggcaggagaatggcgtgaacccgggaggcggagcttgcagtgagcagagatcgtgccacttcactccagcctgggcgacagagcgagactccgtctcaaaaaaaaaaatgtcatttaaaacatctttaacacccaaaacatttatcttcaaagtatctttaaacgtccaatactacatgagctgctgtgagacagattttaaaaagtgatgaatcagctacaaagaatagcatgtcatcaatagcaaaataaattggaaatgctatttaagaaaccaaatcattatcaattatggataatataatgagccaggcatggtggctcacattggtaaccttagcactttgggaggttgaggggggcggatcatttgaggtcaggagttcaaaaccatcctggccaacatggtgaaacccaatctctactaaaaatacaaaaaaattagccgggtctggtggcaagtgcctgtaatctcagctacttggaaggctgcggcgggagaatcgcttgaacctgggaggcagagattgtagtgagccaagatcacaccactgcactccagcctgggcaatagagtgagacttcatctcacacacacacacaaaaaaatcataatatagaatagaaataggtactatgttaaatataatggtggctgctgaactaaaatgatatataaataagagtacaggttttttatagaaaaaaaattgtgccatccattttttaatagaaaaaaagaaaaatacacacaaaaaaagaaaattaagaaacatggatgacattctcttcttcctaccaccccttcctcaccaaaaaataactaaatggatcattcagcttactgtctcttttaaaggctttacataaaacggtagattgattgtgaccttttaaaaatgctttgagacctataaataaataagtaagaataatcctgtctgggtgcagtggctcacgcctgtaatcccagcacgttgggaggccgaggtgggtggatcacctgaggttgggaatttgagaccagcctgaccaacatggtgaaaccctgtctctacttaaaatacaaaaattagtcaggtatagtggcacatgcctgtaatcccagctactcaggggactgaggcataagaatcgcttgaacctgagaggcagaggttgccgcgagctaagatcacgccattgcactctagcttgggcgacagtgggaggctgtctcaaaaaaaaaaaaaaaaaaaaaaaaaattcctactgttagctagactcagtttcctcagtttctaggatatgtaaattttggtctcggaaaataatccatctttctactaatctggtattatcttcctgagctgagtactgaaacaactcccaggtcatcgtattcaccctgagaataggaggatatggtgcatcattcggattcaattcagtagctgtgatgcccatttggtcttggagtggcatgaacttctttactgtgtagcctgtggcttcggagacccttaatacccaccctggttatctcaccacactcaaccctctaggagagaaataatttttaatacaggggtggcatctgttataatccctggcctgccaagtccctgttgatgatgaagctatgttccatctcaggagaggtggggcaggaaaaagcatgagaaccatgactctatagaatgtgttcaattctatagaattgaaagagttatgtgactctttcaattaacattttgcagtatattttcttggcaatatgttttcttctcagagttatcatggaccctaaccttacttcttcctgatttctatgaaaaaaatgaaatcatcccgtatttcttgcttttatggtttcttacagcattctttctcgaactcctgacctcagtgatccaactcgcctcagcctcccaaagtgctgggattacaggtgtgagccactatgcccggccacttttagcactttctgaaaacattttacagaacacattaaaatgtgagatctcaatgcaatgatttaaagtatagcttatgtgattatttaataagcacatatgaattacaagaatttaaacagataagtgatttctaacattttatggtagtctctagagtgtcttcaattatcccaaggaccagcctaaaacaacttgatctttttggacattaataatttcaaaattggatgacttgatgaatatccgtaggaaactagaacttctaaaacactttaggcaacacaagccagcagaaagacaggtgagtggaagcccaggttttaaaaaggcctatttcaggaccttctcaaaatctatgtctgatctagggcaacctgctgacccaacactcctcagacttccaagactaaataaaataccctccctctaagtatcccaaaggttgacttgcaagcaacacttttacgggaagtgtgccttcactacatcaagtcagcactgcagagctccctaaggtctcaggtacccagctaagacatatgaaagtatactgactggtaaggacaaagaagaaggtttgtttctaattctgaccaaaatatcaaaatatatatggtgtctccttaatgctggaagtgatatgaaggaagaacttgattacttcaattaagttatcaagttgaggcccataaatttctaaaattcctaaatgtttgtcattttctactgaggaaacagaagaaaggaatctgatttgctttggacaaaaaaaataagtgatatatttattacacaacattctgaaatcttaatcactgtacctctttaagcacagcacaaactgtagctggtgctacttaacaagcattacaactttcttttttaaaagcaattcttgaatccaagaactaaaagaaagaaattaaagctgtagagaatgctccaacttcagaggtctcatactataccgtgaatcgtgtctgtcacctggaaaccagagtgctccaggcacgatcgcatggacaagcctgcagcagagaacacatgcacatacagctaaagtggtacattacccccaacgcccttcactccacccaacataaagacattccttcccaaagaggggtgggctgcggtcaaaccatcgttccatggaccagaaatccgcattggcttcatgctataaatcccaaacatttaataccagcaagacaaagacactctgaatatgtaaaaattagacatagtagtctgtggtttatttggttatcaaaagaaggcaccaaagcaggtatggaaggactattggtagtaatttggcaactatcttgggagagtatcagctaaagaaatattaggttagaccaaatgggaacgcacaacactagaaaaatgttttacttctgagaaggaagttttgactgccttaggaacacagaattaaaccatactcaaaagtataagggaatttttttaaagcagagtgaacagaacaacttaaattcctaatgatcctaacacaatgaggaaaacagtggcaattcatagaattcagttaccagggacatgactccttcaaggagtaccagcaatgctggtctttgcatggtgtgaccttagtaacataaagaaataggttttagcagctgatttctcagtagctggtagtttaatattaactatttatgagttattccatattttattgtggcttaatttttaattaaactggggctaagagaaaatagggaggaagacatttgttttctagatttaaaaaggacagtgtctcaaatttgactcttttaagttgctaatacatatctgcgttgtgccttgatgcctttattatggttagtactcaaacaagcactaatattagccttctattactcaaaaaacaaacaaaaacaattttccagacaacattcaagagagatctttgatgtgtattataaacgttcatgcctgtgagaccgctcataacggtgaggccaaatctctccactcatgcacagaaggaagtggcttaacacagagtcactgttctgacagaggaagggacaaagcaatcctctgagacttccgccaactggcacaggttacattgaatgaacaatacgtactgacatttgtgtcttccacaattcatgataaataagcaaactggttatttgtaatcagccaaacttgcttctctgaaaaggctgctactggacgttgcagagctcatgttccttcccagtatcagaaaggaaaaaaatcaagttacatttatagctaattttatacatttacgctctcttctagcaattctatctctttccacaatgcaaaggctgaactattacttctcaaaacttctattaaattatcctcctttagttcagggtagttttacagttgagtttggttttcataatctatgtagctaatgaaaataatctcatttccattaaaattaaagacagtctatgtaaaacagacgctaaattatactcacatgcattaagatcagaccaatatttttatgtttaataatttcctacaaataatattgtatagttgtgtgtgtcttatcttgttcatattttcaaaaggacccattcttgaccttgccaaacacaggaattttcataagcaccctaaaactaacacaaatcctaaacaaaaactccaggatacagtcaggaagtttgtttccgtctcatcttagatagaaataggggctagaagagacagatgtttgtgggacagaagctgtggagctgaacccaatcagaaagttttaccttggctttctggcacttaacccttagagaactgtaccaaagagcagtcatttcagtgtcactatggaaataaaggaaatcagacatcttataatgccaagatgaagaaaaatgagaaagttgagaatcatctagttattttaaaccaagtcacctgtaaatcatttgctgatcaaagaacgtgtaaaatgttaccacctctgattctcacagaggtaaaatgttcaaaagctaaaaacaaggaagagaaatggaaagaagggacatactaaactaaatctgtcatataattaaggaaaaatgcaaaatactctgaaaaaatacatagacctattatttgtgcagtagacttcaattaacatttttcaaagaaggagtgaattctaacccatcttaaaggacattatagctgcatttataaagttggcttgggagataccagttatattgtataagtacacatacatgtataggatatgtgtatgctttcccataaggtagagcaaaaagaaggaaagcagaagacttgagtcatactatatttaattctctctttaaccatgatgtgatttattattgggggctctgtatttgctcagccacatctctcaattaatgcaaatcttgacaattttttatcaatcctgacaatttatcataaattctggctttttttgttgtgataggaacaaaaccctcattgtagaccataaatatctccttccattataggccagattcattctaaagagctggctatacattagcaatttcatcacagctagatcacagcaaaaataaataatagaaactttaaagctgatttgaaaatatttggaaaggaatttaaaatcctcggcacagtgtgtggcagctcagcttctaaagcacacagcagctgttgcctggctcgcatcttagaagcttctaagcctgttctctactttgcttcttttgtaccatagccatcttttggagttcttgattttggttcccctcctcatgttgtcacagtactcccaatgaccaacagtctccaatggccattaatatctgaaactcttaactggcaacaagtatgactgctaaactctgcagagctaggaaaccaaatatacttaactctgagactctaggcttcatggtttcctaagtttaaactacaaccaaaaaagtgtgtttgaactaaggactcgaccaactgaataattatattgaaaatatagattcccacctaagaagcaaagaaatagtttttttctaacaaaaatcagtttgttgtctatgtcaactgtcagattgttagaggtatgcttattatccgtatagaaaactactaatttcccatccagtttttttggggtttttttttttttttttgagacggggtctctctctgtcccccaggctgcagtgcagtggcatgatcttggctcactgcaatctccacctcctgggcttaagagatcttcccacctcagcctccaaagttgctgggaccacaggcacatgccaccacgcccagctatttttttatagagatagggtttggccatgttgcccaggctggtttcaaactcctggactcaagcaatccacctgccttggcctcccaaagtgttggaattacaggagtgagccaccatgaccagccctaatttccctttctatccaaggtgctttcaagtatggtttctaccttacatcagtagatatagcttcaggaatggaaactcatttaacatttgcctaataaaaatataactgagaagctaaatgtagggtacctcctccccccaaattggaattatatgtaaaacatactccattctattagtttggtaagagctaattacattttaagtggcttaaattattctttttatttttcttagttacttaatagtcttttttcttagaaataaatcgggacatataattctgttcaaacaaattttatttccagacatttctactgtatttaactactgtcaggtactacttccagactgctaaaatttcaaaatggaagaaagactaacaattgacaatgaatctttattagaggaaggctaattgccaagtagtaggctatgctgcagctggcttttactaagtgactcatataataaaccagaacattctagagttgggctgtccaatacagtggccacgagctacatgtgactattttaatttaaattaattaaaattaaaaacaatttaaaactcagttcaacagccacacttgccacattccacatattcgttagtgacatgtggctgatgacgagtgtatcagacagcacagatgcagaaccctccattactcccatcactatagcactgttctagagcacaggattaaactcccaggttagtctagcccacagaggagcaccttgtaacacatttaaaatgcttcttaagttagaaatgaaagcctcataaatcagatttaaacaatagttttaaatcacatgtaatttcagcatctacttattattgtaaaagtgttgtataaatgcaaaacacaaaaaacagcagaaatgggacttaatcgttgcagaacgtaaacagtcctcaaagaaaaaatgactatcaagacatagcaggccaagtgcagtggctcatgcctgtaatcctagcattttgagaggactagacgggtgcatcacttaaggccaggagtttgagaccatcctgggaaacatggtgaaaccctgcctctacaaaaaatacaaaattagctgggcgtggtggctcactcctgtagtcccagctactcaggaggctgaggtgggaggatcacctgagcccaggaggtcgaggctgcagtgagccatggttgtgccactacactacagcctgggtggcaaagtgagatcctgtctcaaaaaataaaggcacaccagtaaaagtgccaaaataatgatgaaagatttcaaaaactatactttgaaactgcaacttgattaaatttaaaacccaagctgcatggtgaacacaagaatcttttctgcttgtgtattaacagcaaggggtctgtgttttcagctggcatcaactgttgtcctagctggatgccagctatctgcacctaatgacaaagtgacctcagatatcctcagcaagtgcacacgtgtgtggaatagctacgtaccttcaaacatactaacttgttcccagcatttttagatcttaaccatttccacagcttgacagagtcaaggaaaagctatccaattaaagggtttcttcacattatgacaatttttttaatgaattaacatctagactgccaatttgaactttaatatttctaaacatataatcaaatatcatatggatatgatctactttttagattgagctgaaataggccggtcttttaaaaaatttagtttgaaaactactctgctctatttcattaagataaaaatgggcccttccaaagaagattaaaatggatatcagggccaggcgcggtggctcatgcctgtaatcccagtactttgtgaggccaaggcgggcaggtcacaaggtcaggagatcgaaaccatcctggctaacatggtgaaacctcatctctactaaaaatacaaaaattagccaggcgtggtggcggacacctgtagtcccagctacttgaaaggctgaggcaggagaatggcgtgaacccaggaggcgcagcttgcagtgagctgagattgcaccactgcactccagcctgggcaacagagcaagactccatctcaaaaaaaaaaaaaaaaaaaaaaaaagccaggcacggtggctcacacctataatcccagcactttggaggccgaggtggacggatcacgaggtcaggagatcgagaccatcctggctaacacggtgaaaccccgtctctactaaaaatacaaaaagtgagccaggcgtggtggcaggcacctgtagtcccagctactcaggaggctgaggcaggagaatggcgtgaacccgggaggcagagtttgcagtaagccgagattgcaccactgcacaccagcctgggtgacagagcaagactccgtcgcaaaaaaaaaaaaaaaaaaaaaaaaaaaaaaacaggtatcaaaatcctaccacaggccaggcgtggtggctcacacctgtaatcccagcaccgcgagagggtgaggcgggcagatcacctgaggtcacaagtttgagaccagcctggccaacatggtgaaaccctgtctctactaaaaatacaaaaattaggcgggtgtagtggcacacccataatcccagctactcagaaagctgaggcaggagaatggcttgaacccgggaggcagaggctgcagtgagccgagatcgtgccactgcattccagcctgagctacacagccagactccatctcaggaaaaaaaaaaaaattctaccacagaaatacctcaacctggccgggtgcggtggctcatgcctgtaatcccagcactttgggggaccacggcgggtggatcacttgaggtcaggagtttgagaccagcctgaccaacatggtgaaaccccgtctctactaaaaaagtacaaaattagccaggcgtggtggcatgcataacgtcagctacttgggaggcttaggcaggagaatcacttgaacccgggaggcagaggttgcagtgagctgagatcacgccattgcactccagcctgggcaacaagagtgaaactccatctcaaaaatatatatatcaacctaatatttctaccgtgctcaatgaaatagtaaattcatgacattaataataataataataaacccagacaagttgggatatcctataactggataattcaataggtactttaagaattagattatctaatataaaactttagaaagattatgactgtaacaaacaactcaaagttttaaagaaatctcagagaaacagttattaaattcagcttcgttgagatcatactttgttaactgggactatcctctaaaatcttttggataatgttataaaaacaataccttctccacattagaactttataatctaaatctgagctgaaaattttaatcaatatgtagaaccaagaatcatcaagcactattgaagatttaaccaacattgtaccttctctggatgtaaaactgggaatacttgcactagtttactaataaataataactaaaaaaaacacgaattaacttagaatgcaaaccaagctgtgcagcccaattaaagtaaaagtaaaagcaatatactcaaatatctttagtaacaccattaaagtatttaaaatctctttccaaggtatctcagcaaagaggatttaaaatgttaacaggatccccccctcccaaagtagcctaccaactcaccatctgcaaaatcgctccatacagccgcaggagcactttccgaggctcatcaccaagggtggctgtggtgtcaggtagggagcactggaacagcatgttgctaaggccgcctctgtcagaaataagaggacagtaagtatctttattgcaggtgagctaaatcactcttcttggataaatatggatgaaaagtcagggttacacaagaactgttctcatcttatctcgatttattctctcaatttaactccatgagtcacattaaaaacagacaaattccctttctgtttttctgcagtagaggtggggaagcgtttttgaaattgcccgtgtgggccgggcacggtggctcacgcctgtaatcccagcactttgggaggccgaggcgggtggatcacaaggtcaaggaatctagaccatcctggctaacacggtgaaaccccgtctctactaaaaaaatacaaaaaattagccaggcgtggtggcaggtgcctgtagtcccagcaactcaggaggctgaggcaggagaatggcatgaacccgggaggcgaagcttgcagtgagccgagatggcaccactgcactccagcctgggcgacagagcaagactccgtctcaaaaaaaaaaaaaaaaaaaaatcttgaggcaatatttaaaccttcttctctagggctttccatttgatatgtattaatagttccaagatcttctacgctagtgttactaaaaatctgtcaactgattttgactaggagcttgttcaaaaaactcccaacattaactggttaccacggccttcagatgaaacaggagacctcaatactctaatcacacaccaagtaagtagctaagcaaggaatcaaacccaggcatatggctcgagtccctgcttgtaactaaccatgaagagttgtcaaagagataggaggcaaagctggagagcaccatgtgccacattaaagacattacaggaggtcgggcgcagtggctcatgcctgtaatcccagcactttgggaggccaaggcaggtggatcacctgaggtcaagagtttgacaccagcctggccaacatggtgaaagcctgtctctactaaaaatataaattagccgggtgtggtggcacacaccttgtaataccagctacttgagaggctgaggcagaagaatcgcttgaacccaggaggcagaggttgcagtgagccgttatcgcgccactgtactccagcctgggcgacagagtgagactcctatctcaaaaaaaaaaaaaaagaaaaagaaaagataaaagaaaaatgtcataggagctgcgtgagctgcaaaatcaccttccatcaggactactctctataaacctctatgacacaaacatctccatgtcctattactgctataacaaattactacaaatttagtggcttaaaactgaaaacagattctgatcgagctcattaatttttaaaaataagggtaactaggtggaaatggggagttggtttaagtttaatgggtacagagtttcagtttgggaagacgacaacattctggagacggatggtggtgatggcagcacaacaatgaatgtacttaatgccactaaactatatatttttaaattgttaaaattgtatttttaatgctgcttattttaccacaattttacttgattttatttatttatttatttttttcagagagggttttgctctgtcatccaggctagagtacagtggcacaatctcggctcactgcaacctccaccacccaggttcaagcgattctcctgcctcagccccccaagtagctgggattacaggtgtatgccagcatgcttagctaatttttgtatttttggtagaaacggagttttgccatgttggccaggctgctctggaactcctgacctcaggtgatccacccatctcggcctcccaaagtgctagaattacaggcacaccatgcctgaccttattttaccacagttttaataaaaaagtatgaagtactgatatatactacaacatgaaacttaaaaacattatgctaagtgaaagaagacagtcacaaaagaccacatgttatatgattccattcatatgaactgtccagaacaaggaaatctataaagtccattagtggttgccaggagctggggtgggaaggggtacttaggggtaggggatgatagctaaaagtttctttttgaaagatgaaaatgttctaaaactgactgtggtaacagctgcaagtatctgtgattacactaaaagccactggactgtacaatttaaatgggtgaattgtatggtttgtgaactatatctcattttcttaccaaataaaaaatttgaatgtgcttctagcacaaacaattttttcccagatttaagtaagacatatttaagaggttttttcaaaggttacttaaaatgaaaaaccatcatgagtctctaggaacaagacagcaagagtcaggatctattttcccagaaggttgtctaccttagttaaaaagaacaaaaataaaagggaacccaaagttcttgttttcccaaagcaagctgtgaagcaggccgacagcgtgtagatcaaaggaaccaaaagcagccttaacctttctgttaaacttggcgtggcgcctcaactgtgtggcttatcagaatccccctgccgcgtctggtcacagccaacatgggtttctggctaccaagcaacagaacgggcattaaaacagagttaaaagccctagtttttcttccggtcacatactctggaaatctcagtcaaatgcaaaggcaaacagatgaagtactgttctaaattgtgtaacctgattcaaagtttacccccgtactgctaaagaaggaaggcagactagcttggccagaaacaagctcacaacctggaaacccttcaactgctttttattacctgtagcctctattgttcaataggttttagtgaataaattgtcaattattttttagtgacagtcaaaataaatgaagcaaggtgactggcaccaataacccaaactgtgagaaatttacctagaaaaaaagccaactaacaatgagtcaaataataatatgaccaggaacaataaaatgtggtaggaagaaatgccagaaatggtagcaaaaatgtaacagttcaatttatcatataatttgtcaaaaatatcctcccaagtaaaaccccaggagctctcaaggatttgcaagaagttttgaaaccacaaactttatcacctggcataatagctttataagtcataattagatatgagaggcatgggctggatgtggcggctcacgcctgtaatcctagcactttgggaggctgaggcgggcagatcacttgaggtcaggagttcaagaccagcctggccaacatggtgaaaccctgtctctactaaaaatacaaaaattagccgggcatggtggcacgtgcctgtaatcccagctactcaggaggctgaggcaggagaactacttgaacccgagaggcagagattgcagtgagccgagattgtgccattgcactccagcctgggggacaagaacgaaacatcatctccaataaataaataaataaataaataaataaataaataaatacaagagcgaaacatcatctccaataaataaataaataaatttaaatatatatatgcacacacacacacatatatatgagaggcacaagatactcaagcaaaatctcaaatacagtgacaataacacacttattccacactcaacacaatgacaggaaggaaacagaaaaaagcaggaagtacctgctggcaggaattctcacccctgccctccagacccagtggtgcacgcatcactaactgtcaacccatgattccttaaaacagaatactaagggaataacaagcagtataaagaggttcttttttttttttttttttttttttttttgagacggagtctcactctgtcacccaggctggagtgcaacagcgcgatctcggctcactgcaagctccacctcccaggttcacaccattatcctgcctcagcttcccaagtagctgggaatacaggcgcccaccaccacaccgggataatttttttgtatttttagtagagacggggtttcaccgtgattagccaggatggtctcgatctcctgacctcatgatctacctgtctcagccccccaaagtgctgggattacaggcgtgagccaccacgctggtccaaagaggttattttacataaattgttgagcaaaaatgaaatgaatcatttcagcttctcttgatagccagaaaaacaaggcaagagaaagaaataaaaggcatccaaattggaaatgaagttaaattatccctgtttgcagacaacatgatcttacatatagaaaaccctaaagaccccaccaaaaaactatgagaactaataagttcagtaagattgcaggatacaaaatcaacatacaaaaatcagtagcagtattatttctaaacgggaggctcaggtgggaagatcacttgagcccaggaggtcaaggctggagtgagctgtgatcacgccactgcatgccagctaatagcaaattatctggaatggaaatcaagaaaacaatcctgtttacaatagctaacaaaaaaaaaaagaaaagaaaaagaaagaaatttaaccaaggaggtgaaagagctctgcaatgaaaactttaaaatattgatcagagaaactgaagacacaaataaatggaacaatatcccatgttcatgtattagaagaattaatattgttaaaatgtccatactggccaagcgcgtggctgacgcctgtaatcccaacactttgggaggctgaggtgggctgatcacctgaggccaggagttcaagaccagcctcgccaacatgataaaatcctgcctctactaaaaatacaaaaattagctgggcatggtggtgggcgcctgtaatcccagctactcgggaggctgaggcaggagaatctcttgaactcaggaggcggaggtggcagtgagccaagatcacgccactgcactccagcctgggtgacagagcaagactctgtctcaaaaaaaaaaaaagaaaaaaaaaagtccatactacccaaagcaatctatacattcaatgcaatccctatcaaaataccagtgacattcttcatagaaataggaaaaccaatcctaaaatttatatgaaatcacaaaagaccccagtagccaaagcaatctggagcaaaaagaacaaagctagaggaatcacactacctaacttcaacatatactacaaagtcatagtaaccaaaacagcatggtgttggcataaaaacagacagagaccaatataacagaataaaagcccacaaattaatccacacttacagctacctgattttcaacaagtgtcaagaacacaatagggaaaaagacagtctcttcaataaacagtgttgggaaaactggatatcgcacgcacaagaatgaaattagatccttatctcacaccatatacaaaaataaactccaaaatggatcgaaaacttaaagtaagacctgaaactatgaaactgccataagaaaacatagggaaaaagcttcatgaccttggtctgagccaggaattttttttaaaagacctcaaaagcacaggcaacacaaacaaaaataaacaaataggattatagcagactaaaaagcttctgcacagcaaaggaaacaagagtgaagaaacaacctacagaatggaagaatctatttgcaaactatacatcagttaaggggataatatagaaaatatacaaggaactcacagcaaagaaaggaaagaaaaccaattaaaaaatggacaccagctactcaagaggctgaggcaagaggatcactagagcccaggaagtcaaggctgcactgtactttagcctgggtgacagagcaagaccctgtttaaaaaaatatatatatatttgccctaaatggtggcgtgtgcctatattcccagcttgggaggctgacataggaggattgtttgagcctaagagtttgaggctgaagtaagctatgaatgcaccactgtactccagcctggatgacagagcaagattccatccctcaataacaaaaacaaggcaaaagacccaacagacatttatcaaaagatgacaaataaatggccagaaagccacatgtggtaggtagcacgtgcctgcagtcccaactactcgggaggttgagatgggaggatcacttgagcctgggaggttgaggctgcaaatgagctgtgattgtgctactgcactccagcctgggtgacggagcaagaccctgtctcagtaaatttaaaaaaaataaaataaatggccaacaggtatatgaaaaaatgctgaccaccactagtcattattagactgtctattttcaatgataaaagataacaaacgttgacaaggatgtggagaaaagggaacccttacacactgttgatggcaatgtaagttagtacagatatgaaaaacagtatgcagggtcctcagaaaattaaaaatagaattaccattaagatccagctcctgctcatcaaagcaagtttaaaaaaaaaaaatccaggcttggtgcagtggctcatgcgtgtaatccctgcactttggaaggctgaggcgggcagatcacctgaggtcgggaattcgagatcagcctggccaacatggtgaaactctgtctctattaaaaaaacaaaaaaattagccacgcatggtggtgtacatctgtaatcccagctatttgtgaggaggaagcacgagaatcacttgaacccgggaggcagtgttgcagtgagccgagatcacaccactgcactccagcctgggagacagagcaaggctcagtctcaaaaaaataaaaaataaataaattaattaaataaaataaaaaattaaaaatccagcaatcccattactggtaatacatccagaggaaatgaaatcagtacatcagacatctacactctcatgtatattgcagcactagtcacaaaagccatcaattgattatagaataaatgtaagtgtccatcaacagatgaataaagaaaatgtggtatatatacacagtagaatcctattaagccttataaaagcaggaaattctgtcatttgtgacaatatggatgaacctggaggacagtacttatattaagcaaagtaagtcaggcacagaaagacagtaacaatgtgatctcacttgtgtagaatctaaaaaagttgatctcatagaagttgagaatagtgcttaccagaggcgaggggaggggagacagggagaggttggccaactggtacaatattatagtcagatggaaggaataaattcaccttatacctcataaataggacaattattattattattattttttgagactgagttttgctctatcatccaggctggagtgcaatggtgcaatctcggctcaccgcaacctccgcctctcaggtttaagcggttctcatgcattagtctcctgagtagctaggattcaggctcccactaccatgcccagctaataatttttgtatttttagtacagatagggttgcaccatgttggtcagctggtctcgaactcctgacctcaagtgatccaaccgcctcggcctcccaaattgctgggataacaggcgtgagccaccgcacccgaccaatatgtacaattattacatgtcaattataaacattatgaataatgctccattgcctcagcacttacatcaaatacacaggttataaaattataaaattctggccgggcacagtggctcacgcctggaatcccagcactttgggaggcaaagacgggcagatcatctgaggtcaggagttcaagaccagcctgatcaacatggtgaaaccctgtctctactaaaaatacaaaattagccaggcgtggtggcacatgtctgtaatctcagctactcaggaggctgaggcaggagaatcgcttgaacccgggagatggaggctgcagtgagttgagatcgtaccattgcactccagcctcggcaacagagtgaaactccatctcaaaaaaaaaaagagattatttaatgcctgttacattctatagcactataaaacaagaaaaacccatgctacatgctacagtgatacaacaacttagtaggctgcccaaggtcttgaaatatgtcatctctaggccggacatggtggctcacgcctgtaatcccagcactttgggaggctgaggcgggtggatcatgaggtcaggaattcaagaccagcctggcaaacacggtgaaaccccatctctactaaaaatacaaaaattagctgggcatggtggcagacacctatagtcccaactactcaggaggctgaggcaagagaatcgcttaaacacgggaggaggaggttgcagtgagccgaaatcgggccactgtactccagcctgggcagcagagtgagactccatctcaaaaaaaaaaaaaaaaaaaaaaaagaaaagaaaaagaaagaaatatgccatctctaatgtcaaacatctacctatttttaattatttgggttttttcccctgtcatttttagcaacggggatattttgggattcatgtatgtgaatccgctgaatgaatgcttaggcagatgacaaacctgaggaactgtctgctccaacctgtaacacaaagatttccacctgataaattaagataagaagttacctaaccaactatattttgctgaaaagcaaaaaagccactgaaagctccgcaaactgtctacaagtcacagggtacccagtctagcacatacagggcttagtccccaaggctgagggcctggacctaggagaaaatagagcaggcagttccatgactatcatctaaaagtcaaaatgactagaaagaaaaaaaaatcacgacataaccagtgtctcaacagagaaatgatctttaagccatagggctggctacatggaaaagagaatacagcgtaatatcaaaacagctactgaatttagagcacaaggaaaataagaaaaaaaagcagatttttgaaaaatttcttctaaccatctaaaattcaaattgcagctatggctcaggtgaaaaaaacagtgctgcagtaaaacatcagcacctctacggagtaatcaggacggtattaaccccctcctctctgaaaacaagaaaagccaggaggtaccattaaaagaacaggctaggccaagcacagtggctaacacctataatcaatctcaacacttcaggaggtcaaggtgaaaggattgcttcagcccaagagctggagaccagcctaggcaacataacaagactcgatctctacaatttttttttttaattggccaggcatggtggcattgagcctgtggtcccaggtacttgggaagttgaggtgggatgactgcttgagcctggaaggttggggctgcagtgagccgtgatcacgtcactgcactccagcctgggcaacacaaaaaccctgcctccaaaaaaaaaaaaagaccagtccagcccaggtggagtgctggctctgcacaaaatagctgtgcagaccttgggcaggcctccaagtctgttttcacaccataaaacaatgtagcagtatctaacagaagtttctgcgaaaattacatgagatcatatgagctgttcacttatcagcaccaattgcaaagcaaaggttaatgtttaagaggatgccagaaggaagaaaggataaagctcagtcttaagaattctactccagcacggctcagccttgacgctttgtatctggggccaggtcattctttgctgaggggcaaagctgccctgtgtactgcaggaatgtttagcagcaacactgccctctattcactagatgccagctgtactaccaccaacatggtaacaataaaaaacatgttcggccgggcatggtggatcatacctgtaatcccagcactttgggaggccgaggtgggtggatcacgagatcaggagttcaagaccagcctggccaatatggtgaaaccccgtctctactaaaaatacaaaaattagccgggcgcagtggcaggcacctgtaatcccagctacttgggaggcttaggcaggagaatcgcttgaacctgagcagcagtgatttcaatgagtcaagattgagccactgcactccaacctgggtgacagagtgagactctgtctcaaaaaaaaaaatgttcaaacattaccaaatggcgagatgcgggtacaaaatcaccccactattcctctactttttttatcattctttctgcagtttttacctatttttccttccccaaaatttgaaaaccaatttgttctctaacttgattcccaacttataatcttttccttcctctattcaaaataatttcttcctcctgatttgcctatttcagttaacagtagtgcctttttcccactcacccaggctcaaaatcttcctcgtttccaatggcctggtcctctccctatctcccaaattctctcctcctttccattctcaatgctcctgcccaaatgtatatcctcccccaacccccactacagcagcctcctctctggtctcccagcttcttgatccctctctcctctatgctatcccctaggccaccttagaaagtgtttctaaaatacaaatttcaagccgccactgtccttagcacagtccttggaacacagcatgcctctgcctacccttcccacctaggaggtccttccaccaggcatggtcagaagtactccctcccactttctcataaagtgcttgcatcccttctagcccacgctgactcccagtcaatactcgacaaaaagagtactaggcacattaagatgtgtaaatacattacgaaagacacggaaattacgatctcattgtggaaaactaaagataagggttgtgccccaccacgcagcagaacgaggagattccctgccactgacagagaatggagagatcctggaaggacgctagacaggctgacggggctccactggaggggaaaacaggaaggagaacgtgggcatcactgaaagcaatatatgacagataacagaagaagtgcttttattattattattatctaaattctactcctagctgggtgcagtggcacacacctgtagtcccagctaatgaggagggtgaggtgggatgatcgcttgagcccaggaattccaggctgcagttgagctatgatcccacaaatgcactccagactgggcaacaagagcaagaccctgtctcaaaaagaaagaaagaaaagaaataccactcaaccttctggtttccagtccagtatgtgtaagaagcttagaagtcgccacctgatcctaacaacatgtaaaaagctaaatcaactgaaaaatcaactcttaaagaaataaggtggctgggcgcagaggctcacgcctgtaatcccagcactttgggaggccaaggcgggaggatcacgaggtcaggagatcgagaccatcctggctaacacggtgaaactccgtctctactaaaaatacaaaaaattagcctggcgtggtggcgggcgcctgtagtcccagccacttgggaggctgaggcaagagaatggcgtgaacctgggaggcggagcttgcagtgagccaagatcatgccactgcactccagcctgggtgaccgcaaggctctgtctcaaaaaaaaagaaatgaggttaagggggaaactgctgcctcccaaattggacagacagaccggcagatacagagaatcacagtttactggagcaaaatcctccaccaaatcagcactagggtaggaaaaccttaactataactaacaaattgccggaggctcagtgtggacaactgtgagagtttaaaactccaggagacccaattactggggagccccattctttgacgagttttacctccaggagctctacgagttccttacagtgaaaactgagggggggaaaaatcccttcatgcttccagcagagggaggggcaaagaaacctttccttttttcttttcctttttttttttttttttttttgagacagagtctcgctctgtcccccaggcaggagtgcagtggcgcgatctcggctcacagcaagctccacctcccaggttcacaccattctcctgcctcagcctcccgagtagctgggactactggcgcccgccaccacactgggctaattttttgtatttttagtagagacggagtttcaccgtgttagccaggatggtctcgatctcctgacctcgtgatcctcccgcctcaggctcccaaagtgctgggattacaggcgtgagccaccgagcccggcctcttatatttttaaatacgacagaacattctgttcttaacaaggtctgccctcaggagaaattattttgccagtgtctaacctgttgggattttctcagagcctaaacttcctgagagagggcaaatacacaattccagccccctctggccattctgtcccacctaagcggggaggagaactaagaaaaatgggtaaagttcacagtctaggtgcacaggctcaccaaaagactgagacctcaccataggactataggttaaacattcaaaaatcaacaataggctggatgtggtggctcgtgcctgtagtccagcacctggggaggccaaggcaggtggaccacttgaggtcaggagttcaagaccagcctggccaacatggtgaaaccctgtctgtactgaaaatacaaaaattagctgaatgtgatggtgcacacctgtaatcccagctactcgggtgactgaggcatgagaattgcttgaatccagggagtagaggttgcagtgagccgaggtcacgccactgcactccagtgtgggtgacagagcgagactctgtctcaaaataaaaaataaaaaataaaatcaattaatataatctatcacatcaacaggctaaagaagaaaaatcacatgatcatatcaatagatggagaaaaactatctgacaaaatccaacacccactcatggtaaataataaactctcagaaaatgaggaatagagaggaacttcctcaacttgataaagaacatctataaaaaacctacagctaacattatacttgatgagaaagtcacagcttttctacgaagaacaggaacaaggtaacaatgttccccctcaccacttttttccaacatcataggaagtcctaactaataagaaaaggaaattaaaagtatacagattaggaagagagaaataaaactttgtagatgatatgattatctatgtagaaaatcagaaagaagtgaaaaaaaatttctggaataagagattatatagcaggactgcaagatacaaggttaatacataaaagtcaaccagtttcctacataccagtgacaaataagtggaatttgaaattaaaagcacattaccatttatatgagcacccccaaaaatgaaatacttatatataaatctaacaaaatgtgtattttgttatgtcactcaatgtgtattgagtcatgggtaggaagactcaatattatcaagatgtcggttcttcccaacttgatctgtagatttaatgcaatcccaatgaaaaccccagcaagttattttgtgaataccaatgaactgattctaaaatttacagggaagccaggcacagtggctcatgcttgtaatcccagcaatttgggaggccaaggtgggcagatcacttatggtcaggagttccgagaccagcctggcaaacatggtgaaaccctgtctctactaaaaatacaaaattagctgggcgtggtggcatgcacctataatcccagctactcgggaggctgaggcaggagaatcgcttgaatccaggaggcggaggttgcagtgagctgggatcacgccactgcactccagcctgggcaacagaatgagactccatctcaaaaaaaaaaaaaatgataataataataaagtttatcaggagaggcaaaaaacctagaatagccaatgaagaataaagtcagaggaccgacaatactcaacctcaagaatcattatgaagctacattaattaggccaggcgcggtggctcatgcctctaatcccagcactttgggaggccgagctgggcagattacctgaggtcaggagttcgagaccagcctggccaacatggtgaaaccctgtctctactaaaaatacaaaaattagctgggcgtggtggtgggcgcctgtaaccccagctactggggaagttgaggcaggaaaattgcttgaacctgggaggcagaggttgcagtgagccgagatcgtgccattgcactccagcctgggcaacaaaagccaaactccatctcaagaaaaaaaaaaaaaatgagccaggtatggtggtacacacctgtaatcccagctactcaggaggctgaggcatgagaatcacttgaacccgggagacagaggttgcagtgagccaagatcatgccattgtactccagccaagacactatctcaaaaaataaaaataaaaaagctacattaattaaaacagtgtggtattggcaaaagaaaggacaaatggatcaatggaacagactagagagtacagaaatacactcacatagtcaacagatctttcacaaaggagcaaaggcaatacaatgtaacaaatgtcttttacaacaaaccatttgttgtttcaacaaatggtcctggaacatgcccggcgcggtagctcacacctgtaatcccagcactttgggaggctgaggcgggtggatcacttgaggtcaggagtttgagaccagcctgaccaacatgaagaaaccccgtctctactaaaaatacaaaattagccaggcgtggtgacgcatgcctgtaatcccagctactcaggaggctgaggcaggagaatcgcttgaacctgggaggtggaagttgcggtgagccgagatcacgccattgcattccagcctgggcaacaacagcaaaactccgtctcaaaaaaaaaaaaaaaaaaaaaaaaaaagtcctggaacaacgggacgtccacatgcaaaaaaaatctaaacagacgttacacttcccaaaaattaaatcaaaatggatcataaagctaaatataaaatgcaaaactagataatttcttgatggtaacataaaaaaaaatctagatgaccttaggtatggtgattgcttttatttatttatttactttttttgagacggagtctcactcttgtcgcacaggctggagtgcagtgccgcaatccaggctcactgcaacctccgcctcccgggttcaagcgattcttcctgccttagcctcctgagtagctggcattacaggtgcccacgactacaccggactaatttttttgtatttctagaagagacagagtttcaccatgttgtccaggctggtctcaaactcctgacctcaggtgatccacccatcttgtcctccccaagtgctggaattacaggcataagccactgcgcccagccagattacttttagatacagcatcaaaagcatgatccatgaaagaaataattgataggccagacttcattaaaattaaaaactgctttgcaaaagatactgtcaagagaatgaaaagtcacaaacaaggaaaaaatatttgcaaaagacacatttgataaaggactgttaacaaaaatatataaagaactcttaaaactcaagaataggaaaacactttcccactcaagaaggtgtggcaggtgcctggcacggtggttcatgcctgtaatcccagaacttcgggaggccgaggcaggaggatcacgaggtcaggagatcaagaccatcctggctaacacagtgaaaccccatctctactaaaaatacaaaaaattagccgggcgtggtggcagccgcctgtagtcccagctactcgggaggctgaggcaggaaaatggcgtgaaaccgggagacggagcttgcagtgagccaagatcgcaccactgcactctagcctgggcaacagagcaagactccgtctcaaaaaaaaaaaaaaaaaaaaaaaaaaaaaaaaaaagaagctgtggcaggaaaaaaaaaaacaattaaattaaaattttaaaatgggcaagaagctctgtggcatgcccctatagtcccagatacttgggagactgaggcaggaggaccacatctgtgaatacccactacactcaagcctgagcaatgtagcaagacccagtttcttaaaaaaataaaaaggaaaaagaaaaagacacaaactgacatctcatcaaagaagatatacagatagcaaataagcatctgaaaagattttcatcatatgtcattagaaagttgcaaattaaaataagatacctgactgggcgcggtggttcacgcctgtaatcccagcactttgggaggccgaggtgggcagatcacgtgggtcaggagttccagaccagcctgtccaacacagtgaaacccacctctactaaaaatacaaaaaattagccgggcatggtggcaggcgcctgtaatcccagctactcaggaggctgaggcagagaactgcttgaacccgggaggcggaggttgcagtgagccaagatcacaccactgcgctccagcctgggcaaaagagcaagactctgtctcaaaacaaaaacaaaaaacagccaggcgcgatggctcatgcctgtaatcccagcactttgggaggccgaggcaggtggatcacctgaggttaggagttcaagaccagcctggccaacatggtgaaaccccatctctaaataccaaaaattagccaggcgtagtggcaggtgcctgtaatctcaagaactcaggaggcagagacaggagaatcgcttgaacccaggaagcggaggttgcagcaagccgagatcgcgccattgcactccagcctgggcaacaagagtgaaactctgtctcaaaaaaaaaaggaaagaaaaagaaaatgagagaccattatacgcctaccagaatgaccaaacaccagaatgctgacaccaccaaatgctagtaaggacatagaataacaggaaatctcattcactgctggtaggaatgcaaaatgttacagctactctggaagacagtttggcagttccttacaaaactaaacgtaactctcaccatatgaccagcaatcatgctcctaagtatttacccaaatgaattgaaaacctacacacaaatgtttagagcaactttattcataattgccaaaaccgtgaagtaacccagatgtccttcagtagatgaatggataaataaactgtggtatatccagatgacagaatactactgagtattaaaaagaagtgagttatcaagccatgaaaagacacagggaggctgggcacaggggctcacccctgtaattccaacaccttgggaggccaaggcaggcagatgacaaggtcaggagttcgagaccagcctggtcaatatggtgaaaccctgtctctactaaaaatacaaaaaattagccaggcggggtggcacatgcctgtaattccagctacttgggaggctgaggaaggagaattgcctgaacccggaaggcggaggttgcagtgagccaagatcgcaccattgcactccagcctcggcgacagagcgagactctgtctcgggaaaaaaaaaaaaaagaagaagaaaagacaagacaagacccagggaaactcagtgcatattatcaagtgaaaaaagccaaactgaaaagactacatactgtgtgattccaattctatgacattctggaaaaggaaaacctatggagactgtaaaaagaccagtgattggctgggcttaggagggaaagagggataaacagacattaagtagaggatttctagggcagtgaaactattctgtatgacactacagatggtctccaacttatgatggttcaacttatgatttttcgactatacaatggtacaaaggtgatatgtattcggaagaaaccatacttcaagtaaacatacaaccattttatttttcattttcagtaatcaataaattacatgaaatatttaacactttattataaaaacagactttctgttagattactttgcccaactgtaagctaatgtgtaagtgttctggcaaattaaaggtaggctaggctaagatatgctgttcagtagattcaatgtattaaatgcatttcaatttatgatggtttatcagggcataaccctgttgaagtaagctcatcatgtaaagcagcatcaatacaatggtggatacatgtcattatacggtggccaaaaaccacagaatgtacaacagcaagaataggatgtagtgtgttatggactctgagtgataatatgtcaatgtaggttcctcagttgtaacaaatgtcccattctggtgggggaagttgagaaaggggaaggcagtgcctgtgtgcaggcagggggttatatgggaactctctgtactatctgctcaattttgctgtgaacctaaaactgctctaaaactgggcacagtggcacacacttgtaatcccagctactaaggtggctgaggcaggagggaccacttgagcccaggagttcaagaccagcctgggtaacacagtgaaatcccccatttctaaacaaacaaatacaagttgctctaaaaaatatagtgtattagtttaaaaaggaagaaagaaaaagaaagccagcaagccagccacccaaggaacaaaactttccagtaaaaacaaagtgtaaataaaattgtatcttgaaaaatgaaattgaaaattgtttctgttcttatatgtaacataatttaggttataatacaactacatatttatgtttaatttgaaaagcaaacgtttaaaatgaaaagtagggagtttgggcacaatttttccaaaaaaattatgatggcaccataagacacaattaacttcctatgtgagttttactgcattaattttacagtatctgaggacttggccagtcttttcatgggactctctccatcttttgatatgattctattttgcagggcccaaggtagcatcctcctcaatggttttcttttcactgttagtgggtctgtggaacgtaatgtcaaaagatgtgtgtgaaacttagtctccaacatttcattcattgaacttcatgaaatcttgtatccttcacaagattttaaacttcatttcacaactgctgtgaccttatcaatcagcaatgaaaataacaaactctaagctgggtgtggtggtttacgcctgtaatccctgctctttgggcggaggcaggcggatcacctgagcccaggagttctataccagcctgggcaccatggtaaaaccccgtggctaccaaaaaatacaaaaattagccaggtagccaggcgtggtggctcatgcctgtaatcccagcactatgggaggccaaagcaggcggatcatgaggtcaggagttcaagaccagcctggccaacatgtgaaaccttgtatctactaaagataccaaaaaaaaaaaatttagctggacatggcatgtgactgtaatcccagctactcgggaggccgaggcaggagaatcgcttgaacctgggaggcagaggttgcagtgagccgagatcgcgccattgtgctcccgcctgggcaacagagcaagactgtcttaaaaaaaaaaaaagaaagaaagaaagaaaatgctaataacatactattgatttgataggcagggacagaagttagtattaagttgtgatgtctggaaatgaacaaattttctaagtggtcagctcattaacaacaactctcatgttaggacaatttttatttttccctataccactcatagttgaagagactcagacaaggatctccgttcatcacacagcaaagaggccaacttaagctaaaaatgacaatttctacacttatccagttccggtgtgccaggcactatcctagtgctggagatacaaagatgaacgtgaaatgccctctaggaattcaatctaacaagagaatggaatgaataaacacacacacaaacgtgttaagggttgtgataacaaggcctgcatgtacaaagtgctaaggatgagacacagaggggaaagaaattcagtatgtctggttctctctgagttaagccttgaaagaggaattttaaaggaaacacaccaagggaaaggctgccaagcagagggtaggggcaaagaaaggcctggtaactgaaaacacaaagctcattcagaaaatgcaggctccagtgtaactagctcaatgttagttgctgtggttctggagaaggagtgattttaaaacagtaataacaaaaagaaccagtctaaaaagttaggccgggcagggtgcagtggctaacgcctgtaatcccagcactttgggaggccaaggagggtggaacacctgaggtcaggagttcgagaccagcctggtcaatatggtgaaaccctatctctaccaaaaatacaaaaattagccggatgtggtggtgcatctgtagtcccagctactcgggaggctgaggcacaagaatcgctcgaacccaggaggcagaagttgcagctagccgagatcacaccagcctgggtgacagagcaagactccatctcaaaaaataaatttaaaaataaaaaataaaaaggtaggccaaggctcaagtttagaccatgcaaacaagtttggattttattttccaatatttgagaaatccatagcaacaagatacagaatggattagaaggaacacacaaaatgcaagaagatcctaaggcacctcctgttctagtgtctaagcaaggacagcaaagggaccagacagaaggtggggatacaaaagtagctcatcaggtttgagttacaactgtgtgcagaggagggatttctgggggaatgcagagttagaaatgatcctggggctctggccaggctgctgctacaaacgcagagcgaaagcagaagcacattcctgggtggggaggagccaaagggttaaatttggaataggaatgcactgagttgaggtggtgaagtctcatcaactactgcagatgcactggcactcagtgaaacacggagctccagaaacggatcggggccaggtatggtggctcaggtctaaaatcctggcactttgggaggctgaagcggaaggactgcttgagctcaggagttcaagaccagcctgggcaacatggcgaaaccccatctctacaaaaatacaaaaattagccagtaatggtggtgcgtgcctgtagtcccagctacttgagaggctgaggtgggaggatcaccagagcctgggaagtcgaggctacagtgagctgtgatcacaccactgcactccagcctgcgcgacagagtgaaaccctgtctccaaaaaaaaaccaaaaaccagaatcagattgggaaatgtcagtaaaatttgatagctggagccataataactgcaactgcctatggagaatcactgaatttcaaccagacgaattcctctccttctccgcacctccaaatgcccttgtgtcttttttaaaagctagacatcacccactttcccatgtcctaaatcacctttttttctccttattaaacttattccataactacgttctctttcagaacacaggactgagagagtgtactcttgcaacattatgtaaaaaggtcatccaatccaaaaggaaagctgtgttttccaagactgctaactcctggagaaaagaaacaagacatcctcaatgctttcctaataactggtttgagcaaaatgcaaaagtttaactgctgagtgactctccctggagaaagccatgaaaatatcttaaggctggatctagggtgtccaaacattttcacaggccgcaggctagagcactggtgcaggagaaggggacaccagagacctggcagttcaggctttgaaggcagtaaacagccactgacctcaggcaagtcacttctcctttaggttttccatttcacagactgatgagtacatggcctaaaatgatcgcccttctagttgagaattttcaggcctaactaaaagtagattaaagtaaaccttggagagagctgaattttttttaagtgccattaagcaattcagggattatctaaacagcctcggttttcttttctctgcttccttaccaactgcctattaactctcactcttagctcataagcagtcagaggggctgaagcacaaagaggaagtgaagctcaaagagttaattttgctgcattagcggctctggtgaaagacagtgggcacagaaaaggaatcaaatgaccaaaactggacttggggattactggtggcagccagccagcaaatttctagatactgcacacaacctgtcagccaattaaaagaaaattggcagaaaatgacggaacacgttctttgtttttgtttttttgagacagtctctctctgtcaaaggctggagtgcagtggcgtgatctcggctcactgcaaccgccgcctcccaggttcaagcgattctcctgcctcagcctcccaagtagctgggactacaggtgtgcgccaccatgcccagctaatttttgtatttttagtagatatggggtttcaccatgttggccaggctggtctcgatctcccgacctcgtgacccgcccaccttggcctcccaaagtgctgggattacaggcgtgagccactgcgcccggcccgggaacacatctttaaaggtctaaatagaaggatgcacacactacgttgaatggttatgtcttcggagcagagtggtgaaagaaggtcagacttctgttaagtctgaatacctacacgcgtacttctgtaattcaaatttaagattaaatattttcaagtttaaaaaaaggaaaaaatggccgagcgcggtggctcatgcctgtaatcccaacattttgggaggtcgaagcgggtggatcacctgaggtcgggagttcaagatcagcctaacgaacatggagaaaccttgtctctactaaaaatacaaaattagccgggcgtggtggcgtgtgtctgtaatcccagctactcgggaggctgaggcaaggagaatcgcttgaacacgggaggccgtggttgcagtgagccgaggtcgcgccactgcactccagcctggggaccaagagcgaaactccgtctcaaaaaaaaaaaaaaaaggaaaaaacatttctaccttactcttattttaggagccacgcctcccacctttgtctagtaacacagctatagtgatgtctcttaggggatgagaaaatgctactcctccactaacaatgactcttggagagggaacaagacatcaaatcgcgaactcgaaaaactaacagaaaaaagttaaaaagtggtttgtgtttttaaagccagccacaacaccttcattcaaggccctaaaccgcagagactttctagacctatcttaagcgtcagtaccacacgcacttcgtgatggaacggtattgttctcctagaacagacccgttttctcatgaaaccgacgtttttacaaaagcctgtttgtggacggcctgcggcggccgcgaacccgcttcccttggattacccagggctgggagaaggagggctttcgccggctgcggtccccggtccccggcctccgccccggccccggctcccccggcccccgacccccccggcccacgccccctgcccggaccccgccccggccccgccccgcgtcacctgactgtcccgcggcccccagacccggcgccaccgacctgatgacactgatgtggaactcgtcctcgcggaggccccgccaggcgccgggcaggaactccttgcaccacagataggccctgcgccgcgtccggggctccggctgctcgtctgcgggcggctgcggcggcgggggctggggcagcggcagcggcagcggcagcggcggcggagggggcagcgcgagcggcggctgttggccgcccagctgcttggactcgaggtcgctggcggcgtcgcgctgctgccccacgccgggcgccggggccgcgctgccgctaccgcagctcagcagcagcccgagcggcgagggctccgcctcgcccccggtgcagaatttggttttcatgcccgacaggcggccgaggaggcgcgggcggccgcagcgcgagaggactaggctcagagtccggccgggcgccccctcgccgctctctcactggcaggccggcggggcagggggccgcggcggttgggcgcgcggggcggcggcggcggctgcggcgactgcggcgactgcggcgactgtggagcggggatgtgctgctggccgctgcactcgctcctctgccgccgccgcacgaggagcgccggccgcgtcacagcccgccctcgcgctcgccactgattggccgccgtccgccggcccggcgcatcataaccgccgccgccctcgccacaccgcctccccattggatgcggcgccgcccccaacccagagcgctgcggcctccgtgagcggggcctgggcgaagggggcggggcgtcgagggggcgccccggcggtcgcagggaagggggagaggggagcgaggcgcggggggcgccgggagagcgcctccgcggtgggacggagccggactgggccgagcgagggaggctcctgagcctcggaggaccccggggttggctttgggagctgaaagtttccttggacccctcggaagccccgtgacatcagaggccgggcctggcaggggcaggcaggaaacgtgtctggaggctactgccctctccgcgtgaccttgggcgagcagcctcctcctggggctcagtgggtgtgattttgtaacatttcccagcgctgcgacaggcgcgtcctcgccctgtccaacgcggagcccgaagaattactaagaaaccgaggtctgaaggagggaagaggtgacgggctcgaggccacacggtgggccaggctgggcccggctgcacgccggctaccggggcccagccctctgcacgcctcccgcagcctcagtttccctgtccgtggtactgaggatgctcgggcctagaagttcagggctggaggcccagggaccgtcgagggaggggcatcatccccgccatggggccgccgcaactgcccagagcacaggccaaaggtgcgtgccacggggctactggcgttgtggacgctgcccctgcctccccatcccccgcaggaaacagccttgtgaccgtgactaacgcacctttgccggggtagaggggcaagggcccctgctaccgtttgccacacactgccccatgtccctcactgctcccgtccttcctagaagtgaggtgctgatacatataaaaattatggatcccattttatgggacatgagctgaaacaggaggtttcctgggctgccaggggcttaggaaatccagtgcctgatacacaggaaatgcttctatgtggggagttcacagtcttccagaagcaaaaatgttttttggttttttttttgagacggagtcttgctcagtcgcccaggctggagtgcagtggcacgatctcggctcactgcaacctccgcctcccgggttcacgccattctgctgcctcagcctcccgagtagctaggactacagacgcccgccacgacgcctggctaatttttattttttttttttttttttgtatttttagtagagacggggtttcatcgtgttagccaggatggtctcgatctcctgacctcgtgatccgcccgcctcggcctcccaaagtgctgggattacaggagtgagccaccgcgcccggccgcaaaaatcttttagagtgtgtacttggctgaacttgctccacgcaaaatggtcttatttaaggataaaaatgaaaggggacttttgtaaggctgctgtggcgacaggcctggaagttgacctgcagggaggtaggagagaccaaggcccctgggacggaggccggccactggatgtttgaaaggctgagaagccaagggcttcaatctggggaggccgtttggataaaggagccaaggactttctctaaaaataccggctcacagggaggtggggccatgccaatggcctgcccaggtgacaagccctttgtcccactgtcccctggcaccagtctggtaatctcaaaggaatgccagaaatctggccaggaggaagggacactaaagtaaggagtggccctctataatttgaaataactctttctggcatctgctggcttttgttaggaaaagcctcagacatttttatgggatcacagttccctgtgggaggaagaggttgcctcaaggccaggcatggtggcttatggctgtaatcccagcactttgggaggccaaggcaggaggatcacttgagccaggagtttgagaccagcctggccaacataacaagactctgtctcgccgggcgaggtggctcatgcctgtaaccccagcactttgggaggccgaggtgggcggatcacaaggtcaggagttcgagaccattccggctaacacggtgaaaccccatctctactaaaaatacaaaaaaaattagccgggcgtaggtggtgcatgcctgtagtcccagctactcgggaggctgaggcaggagaatggcataaaacccaggaagcggaggttgcagtgagccgagatcgcgccactgcactacagactgggagacagagcgagactccgtttcaaaaaaaaaaaagactgtctcaaaaattaaaaatgaaaaaaaaaattaacagggcattgtgtcttacacttgtccgactacttgggaggctcagccaggagcatcacttgagcctgggaggtcaaggcacccactgcactccagcctgagtgacagagtgagaccgtatttgctgaatgaatgaatcagtgagctcctggctcagcaattattaacttatgactttgggctgagcctcggtttcctcaactataaaatggggattataataccccgagcatccaggattgagagaatgtatgcaaaatgcatagcatgcaagaagtaaccgtttggttgcgtgcagtgcattgcatggcgttgcctctgccagtggttggttttcggagatgaataatgcatgcacttgtagcatttcacagcttgggaagacagtgtcgtataagaaaagaatttgggccgggtgtagtagcttatgcctgtaatcccagcactgtgggaggccaaggtgggaggtttgcttgaggccaggagttcaagatgagcctgggcaacaagtgagaccctgtctctacaaaaaataaaataattggccaggcacagtgacatgtgcctgtaatctcagttacttagaagcctgaggtgggaggatcccttgaacccaggagttcaaggctgcagtgagccatgatcacgccactgctctccagcctgggcaacagaggctaggaaaataaaaatacattttaaacaaaaataattcaaacactctgataaccaaaatgtcaatgtctgtgcacaagtagacgagtttgagagaaacttgctatggcaggtaattggaggttgttccaattaccaaaccttttcctctaggataagataaaaaaattatccaaaagctctgtgattgatgctgaattctgagagcagactcagagggtgggtgatgggccttaggagggatagaggaaagattgggaagttcccgtccactctgaatttcctgctgatgggttcctcggggtccacccacgggcctcagccctgccaccaactccaaggcctgttctgagaaagggctttgtgagtctgactccccccaagatgggggaacccactgtcaagcacctggtaggagcaggctttgagccctttcaaagatgctgcatacagcaagttccctaagcagcagtgaggtgagtgtcattagcacttcatctcccaggtggcaagggagcttcccaggggataaaaccattcgttaaaggccagcaggacctgggactccacccaggaccccatccaggggagccttgtccttctgtccttctgcaccataagcacctttggcccaggaagcactagacatttggcacagtgggggttccctcacgggctggagaagcagagccctggcaaggctgtgctcacacctcctcccaggtcacacccaggaccaagcacccctgctccagttctgagccttaaaatattgatgagagcacagaggccacctggctgcaatcctccatgttgaagattgggttgcagtgccagctagcagagtgacatggagctgggctttccctgagtgctgagcgtggccccagcccagctctgtcagcgaaaggctgtgtaggtccagcagctttctggaggtctctgagcacaagtgtggtctgacttggactgacccttctaccatacatttggctcagcacccgcagccagagtctagggcccacagggctcagaggaagcaggtgactagaatatccatctgtctggtgggtggggcaggcattcctcctgtcttcatttgcagggattttgagtataatattatgggtaaaaattctggccaggtgcagtggctcacgcctgtaatcccaacactttgagaggccaaggtggatcacctgggtcaggagttcgagaccagcctggccaacacggtgaaaccccgtctctactaaaaatacaaaaattagccaggcatggtggcacatgtctatagttccagctactcgggaggctgaggaaggagaatcacttgaacctaggaggtggaggttgcagtgagccgagatcatgccactgcactccagtctgggcaataaaagcaagactccataacgcgcacacacacacacacacacacacacacacacacacacacacacacaatctttagaggtcatgctgccacccactgtgtgaccttggacagaacatctacctttctaagccactttcctcatccccaaatggagtcctactctacagggctgttggggagattcaccgaaaccagcaaggaaagagctgggtgtagagccaaagccccacaaagggtatctatgcttttcagcttattgttagctggattcccagagcctggcagagagcagcaaatacccattcatcctaagtgccagtggaagcgcaaagcctgcaggagctctggcaggtctaacagggcctggagagttttccattctttgaagctcctggcacattcaaaaattaagaaaaatctaggcgggacacggtggctcacgcctgtaatcccagcactttgggaggctgaggtgggcagatcacctgaggtcaggagcaagactccatctctaaaaaaaaaaaaagaaacatctcgacagggttaccaaaactggggcatgtttgaaatacttaaattgaacaaatcagtgcttttaacacacatgcaaaagtcccattcaagataattttgcaattctcaaggtaatagagggattactttaaaataataatggagccaaccaagcatagtgacacctgcctgtggtccaagctactggggaagctgaggcaggaggatcacttgagcccaggggattgaggctgtagagacatgattgagccactgactccagcctgggtgacagagtgagatactgtcaataataataataataataataatggtttgtagagcaccttaagtggtatggtgtgacaaacatctttcaggcctgacaacagatctctgtactaatctgattatccttattcagatgtatctaaatctgaggcccttggggcacatgattgcctcctggggctgccatagtagaccctggcaatgacctagtgaccgttcctctactggagatgatcccctgggcccctcagaatgcatttcctgtgtccacatagccggtgttttaagtcaggtgatcttttttttttttttttttttttttgagacgaggcctctctcgttgcccaggctggaatgcagtggtgcaatctcggctcactgaaacttcttcctcatgggttcaagtgactggcctgcctcagtctcccaagtagctgggattacaggtgtgcaccacaacgcccggctaattttggtatttttagtagagatggggttttgccatgttggccaggctagtctcgatatctgcccacctcagcttcccaaagtgctggaattacaggcatgagccaccgtcgccagtcttaagtcaggcaatctaagctccctttccaagtttgttgaaaacctgatttgaggttttgtgctttaagcttgcattacatttgtaacacaataaatgcaatttttggcacaataaatgcaaaattgtggcgcagtgactcatacgtgtaatcctagcactttgggaggccgaggcaggtggatcacctgaggtcaggagttcaagacaagcctggccaacagggcgaaaccctgtctctactaaaaatacaaaaattagctgggcatcgtggcaggtgtctataatcccagctatttaacaggctgaggcaggagaatcacttgaacctggagggcagaggttgcagtgagccaagattgcgccactttactccagcctgggcaaaagagccaaactctgtctccaaaaaacaaacaaacaaaatagaaaataaatacaatttttaaaaagaccccagtcatcatgcaggttacactgtggggataacacttctgggctaggagttgggcaacctgggttcaggcaccgcaccccctctgccggctgcacagggcccctctcccctcagtcagccctgggccctgcaggctggacttttgcctggtagctttgggctggccctcccttctgcaggggaccccttgtacagatgggtaagcagaggcacaggggcacaggcaggacagcggctctgctcacgcaggatgccatggccagtcgtgggcctactccatccttgatcctcccctcccaagggcacttgccatccaggcctgaatggcaagaggcccctaaggggcccccagtcctgtcggcaccccctttgagtgactgacagggaggcaggggagctggcagcccccatccccacaccagcttgtggaagctaccagcgatcggtggggccccactggcagcccgtccgtgtagccttggccgggcccccaagcttcttagaatgccatctaagaaggcagagggggatgagcggcggcggggaggaggggcggccttgggaagatccactgggtccagggaagcgaaggccggaccctcctcccccagcgctactgcccgggccgaattccaaggccagcggctgcccgctgagaaggaatccggaccaacgggattctggcttccctctggcccctcctggcgagagcggcgccgggaggagggggcctcagaaggggcgggcaggggcggggcccgcggggtaggcggagctcccaggaaaacagcgggcggggcctcgcgcgaggggcggggttggcggcgaggcgtcccaggacccccattcctccctccgccccggggcttctggggagcggcgcagcttgactgccaccgactgcgggcctccctgccctacaagcccccacccccgcccccccttgggacctggcgaggagttgccccgcaaagttggggctggtgcggggttaaggggattacaattttcctaggacttagtgtgctgaagctgcttttgcgattagaatttatatttacaatgctgataacaataaactacccaggctaccgcgccacgtggacgggggtggtggttggaaagggaaacccttggccaccagcagcctgtgataaggccaaggttccctggctggattgctgcctaggatgcctgtggtccctacccccgcccgggaggcaggattgactaatccgaccaagcaaggcctccaggctgggccaagaaccccttcccagtcctctcccaaagtctatgtccttgggctcacgctgtcctctcctgtccttgcctcctgcatctacagacccctgaggcctcctcctccttcagagcatgcacgtcgcaaattctcaatgactgtttggaggaatgaataaatgaattgtgaacaaatggtctgaagattccagaggtagcctaatggggccctgctgcttgagttctaatcccagccccaccagttgttggctatttggccctgggcaggtgattattctctctttgcctctgtaccttgcccgtaaaatgaggagaataccagtacctactgcataaggttgttaaaggattaaatgagtgaatagttacaaagagcctggaacagagtgttcaaagaaacacacagccacagtattaaaaaaattaaaaacccatttctctccaggcttctgccatcactctgtgtgacttcaacattctacctgcatgacctatgcagcacctggccgctgttaccttgccaccctcactgacatcttctctgcataggccttccaccatgccctgtactttctccccactagaaatagccctggctctgaaatgtgttttaatcatcccactttgggtccaccagttcctagcctttgagcttaggcctctcctccaggaccctccctggctacgatttcccaacccctctcgaccttccattcactgaccttgccactttcttgcctctagtctgcacctctccccatccctagtgtggattccatccccttgtgaacgctgccacccgtcctggcagagactcagtacttccactctctgaatgcatttcttcttcctaggcacaccagaagactacatttcctagccccccacccccttgcagtgtctgggaccatgtgactccttaattaggtcacttctctctcctgggaggccctctctgccctctctaagtctaactagtggcaaaggatctaagggaagaaacctggcagagttactagttccaagaagcctgggtccctgaatcaccacatggaagtctacgcgcccaccacctgaatggactaaggtatgaacagaagtaatacacacccctttagggccaaggaggtgaaacagctggtatgccttcctcacactctcctctgctttcctggtgacctaggaagctgcaggatgaagacaacagcatcacaaggaggaagccaggatccctgtgttaccacaaggaggagagatgcctaaccaagaccgtctgcaaggattttgtgtgagccagaagcagagctgtatggtgttcagccactgagatttgagggctgtttgttacagcagttgacctatcctgactgacacatcacatcattcctttccccaccatgtgtctaacatgctaccaaattgaattttaagtaaattagtacttataaattaagtacaaatgcttttcaaattcacatgaatctttggtaaataaaactggttgtaaaattattgataaatatagaaatgtctgaaattattgataaaatagccttgtgcaagtaagactaatttaagatcattggttcaatgaaaataactgaatcttctgagttgtcggcaaaatgctcatgtgtttaagattcttagataggtgttcacttaatattcagactttaaaaatgattaaccaggatataactttgaccagcctagtatcatagtttttataagtaatcctgggccgggcacgatggctcatgcctgtaatcccagaactttggaaggccaaggtgggtggctcatgaggtcaggagatggagaccatcctggccaacatggtgaaactccatctctactaaaaaatacaaaaaattagccaggcgtggtggcacgtgcctgtagtcccagctactcgggaggctgaggcaggggaatcacttgaacctcggaggtggaggttacattgagccgagatcttgccactgcactccagcctgggtgacagagtgagactccatctccaaaaaaaaaaaaaaaaaagaattgtggaatcctgctgggcatggtgactcatgcctgtaatcccacactttgggaggccaacgcaggtggatcacttgagatcaggaatttgagaccagcctggccaacatggtaaaacctcatctctacccaaagcacacaaaaaattagccaggcatggtggcagacacctgtaatcccagctactcgggaggctgaggcatgagaattgcttgaacctgggaggtggaagttgcagtgagccaagtttgcaccactgcactccagcctgggcaacacagcgagactccatgtcaaaaacaacaaacaaacgaacaaaaagaattgtggaatgctgctcatccataaaatgctaatatctaatgggcatttcaggatttcttgctttctagatttatataaaatgtgccaaagatgtgttcttattaagaaaaagaagaattttgtctaattcagaagttatctgcccagacgcagtggctcatgcctgtaaacccagcactttgggaggccaagttgggtggattacttcaggtcaggagttcaagaccagcctggccaacatggtgaaacacatctctactaaaaataccaaaaaaaaaaagttatctaaaagtcaattcaaattatggagttaaaagtggttcttggccagacgcagtggctcacacctgtaatcccagcactttgggaggccaaggcaggtggatcacctgaggtcaggagtttgagaccagcctgagcaacatggtgaaaccccatctctactaaaaatacaaaaattagctgggtgtggtggtgggcgcctgtaattccagctactcaggaggctgaggcaggagaatctcttgaactggggaggcagaggttgcagtgagctgagatcatgccattgcactccagcctgggcgacaagagtgaaactccatctcaaaaaaaaaaaaaaaaaaaggtccttaaacaaggttgaaagaaaccattaagtaggggagagagagatgtgaaaaaaattatggatacaaagatgtatttttggcaaagaagcttataaagaaaagacaatacctttatatgagaaaggatcttgtatggaaaattattgtcctagagtagaatgactggttatttaagaaagaggaaggccagatgtggtggctcacacctgtaatcccaaaactttgggaggctgaggcagggggatcatttgagctcaggagtttgagaccagcctggggaacatggtgaaacactgtctccccaaaaatataaaacttagctgggcatggcagcatgtgcctgtagtcccaggtactcgggaggctaaggtgggaagattgcttaagccgaggagattcaggctgcagtgagccaagattgtgccactgcatttcatcctgagcaacagaacaagaccctgtctttaaaaaaggaaagaaagaaggaaggaaagaaggaaggaaggaaggagagagagggagagagagaggaaggaaggaaggaaggagggagggagggagggatggagggagggagggagagagagagaaggaaggaaggaaaggaaggaaggaagacagagagaagctgggtgtggtggctcatgcctgtaatcccagcactttgggaggctgaggcgggtggatcacctgaggtcgggagttcgagaccagcctgaccaacatggagaaaccccgtctctactaaaaattcaaaattagctgggcatggtggcacagacctgtaatcccagctactagagaggctgaggcaggagaattgcttgaacctgggaggcggaggttgtggtgagctgagatcacaccattgcactccatcctgggcaacaagagcaaaactccatctcaaaaaaaaaaaaagaaagagaaaatgaaagaaagagagaaatagtctaggacaagtcagaaagtccaagcaggacatagatggtttgtgtaagttgtgataagatttgtaaaggggaggccgggcgcggtggctcaggcctgtaatcccagcactttgggaggccgaggcgggcggatcacgaggtcaggagatggagaccatcctggctaaaacggtgaaaccccgtctctactaaaaatacaaaaaattagccgggcgtagtggcgggcgcctgtagtcccagctacttgggaggctgaggcaggagaatgacgtgaacccgggaggcggagcttgcagtgagccgagatcctgccactgcactccagcctgggcgacagagcgagactccgtctcaaaaaaaaaaaaaaaaaaaaaaaagatttgtaaaggggaatttacaaaaacaggaattttgtttgtgattaagttagctgcgattaaaaggagattatttctcctttctaaggaatggtcccctatgttaaaagaaggtctgcttaaggtattgatttgctcttaatgaaattataagaaattttgcttttcaattttttgtttgttagttttgagatggagtctcgctctgtcgcccagactggagtgcggtggcgtgatctcagctcaccgcaagctccacctcccagggtcactccagcctgggcaacagagcgagactctgtctaaaaaaaaaaaaaaaagggatgaatgagtgcctgtccacctccatttcatctggcctagcatatttaactgtctacacgtcttttgattctaagtctcttggccacagcggtcccacttagggacataatatagccagggcaggtagcacaccaccctggcatcgatatggggcacaataaaagcttggccatgatactgcctctggcataccatgaccagaaaaaaaaaaaaaaaaaaaaaaaaacacatgcacctgaaaatctagttgaggccatgacaggaagtgggtagggggagggagagtcagccaggcctcactatatttcctcgccttggaattccacacatattttccctgatggtaccaccaattataattcttcttgtcccccttggagggccttagtccctctacaaacaacagtgtctttctcaattcccataactgctccccataatactggtatcacattaaattactactttccccccatcccattcatgcttaaaccaaagcaccccttgaataacacaggtacttaacctttttttttttttttgagacacagtcttgctctgtctcccaggctggagtacagtggcgtgatcctcagcctcccaagtagctgggattacaggcatgtgccaccacacctggctaattttgtatttttagtaaaaacagggttttgccatgttggccaggctggtctcaaaactcctgacctccagtgatccgcctgccttggcctcccaaagtgctgggattacaggcgtgagccactgcgcccagcggtacttaaccttaacagctcccatcccattccagtctgtgatccacagtggatatctgtggctatatggatgcccactaaatcaatcagcctataaacaactcattcctcatttgagaccacgggtaccaatgtgttgataacatttggctcaaaggtcaacatatagtaagacaggtgaagccggccgggcgcggtggctcacgcctgtaatcccagcactttgagaggccgaggcgggcggatcacgaggtcaggagatcaagaccatcctggctaacatggtgaaaccctgtctctactaaaaatacaaaaatagagtcgggcgtggtggcaggcgcctgtagtcccagctactcgggaggttgagacaggagaatggcgtgaacccaggaggcggagcttgcagtgagccgagatcgtgccactgcactccagcctgggcgacacagcaagactctgtctcaaaacaaaaacaaaaacaaaaacaaaacaaaacaaaaaaaagacaggcgaagccttctaatatacaattatacaacatcacttgcccaagcactaagtgagcaattggccttctgttgtctggggtcagggctgctgtgggcttgttggccccatggggaggatttgcctaacatgaggcaactcttcaaaactttacttttcactctacataccttcttataaaatgggagatactttagataaattgagactctctcgattctatagcagatatagttatggataatagattggcattagactatttgttggctgaacaatgacaggtatatgctgtgattaataaaacctgctgtacctatgtaaacaactcaggtcaagtagaggaagataccaacaaaatatatgaacaaggctgggcacagtggctcacgtccagtgcttttggaggccaaggagggtgaatcacttgaggtcaggagttggagaccagcctggccaacatggtgaaaccccatctctaggaaaaatacaaaaattagccaggcatggaggcacatgtctgtaatcccagctactccggaggctgagggaggagaattgtgtgaacctgggaggcagaggctgcagtaggccaagattatgccactgcattccagcctgggagacagagtgggaccctgtctccaaaaaaaaaagaaaaagaaaaaaaaaaaagggccaggcatgttggctcacgcctgtaatcccagcactttgggaggctgaggcgggtggatcacaaggtcaagagatcgaaatcatcctggccaacatggtgaaaccctgcctctactaaaaatacaaaaattagctgggtgtggtggtgcacacctgtagtctcagctactcaggaggctgaggcaggagaatcgcttgaagccaggaggtagaggttgcagtgagccaagattgcgccattgtactccagcctggcaacagagcaagactgcgtctcaaaaaaaaaaaaaaaaaaaaaaaaaagaacaagccaagtggctacatggtgttcacaaccccaatacccaaactactatgcggaattccataaggggtttctaccggcagtgacttggtttttacctaggacctttaatagctctcttgttactattgatctttgtttggcctttacttatttaacctcttagtaaagttcgtgtcttctaaattataacaattccatgtggaaatgatgcttgcactaggtttctgacccatcctgtcttctagcctggaaaataaagatctcctgcctttggggtccttagatcaggcaaccagagattttcactcctccaacaccaggcagagcctatgcccataagatcagcaggaagcagttgtagagggtggacctctgcccttctaccactttttaagattaaggaggagtctgacgcctgtcatcccagcactttgggaggccgaagcaggcggatcacctgaggtcaggagttggagagtagcctggccaacatggtgaagccccgtctctactcaaagtacaaaaaaattatccatgcagtagtggcgtgcgcctttaatcccagctactcaggaggctgaggcagaggttgcagtgagccaacatggtgccactgcactccagcctgggtgagagagcaagactctgtccaaaaaaaaaaaaaaaaggtctggtgcgatggctcacgcctgtaatcccagcactttgggaggccgagacgggtggatcacgaggtcaggagatacagaccatcctggctaacacggtaaaaccccatctctactaaaaatacaaaaaaaattagccaggcatggtggtgggcgcctgtagtcccagctacttgggaggctgaggcaggacaaaggcatgaacctgggaggcggagcttgcagtgagctgagatcacgccactgcactccagcctgggcgacagagcgagactcgggctcaaaacaaaacaaaacaaaacaaagattgaagaggactctacagtctctccgggaaggaataaggttagagatcagcaggacttgttttctgagcaccagtcacaagaccttgctgaacaaaacatgatctgatcaaaagaggatgcaggaaagacattggccaaaactagctaaaaccaacacggtgaccaaagcaacctctagatgccctcattgttcattgtgcactaattataatgccttcgcatgctgaaagacactcccgccagcaccgtgacagtttacaaatactgtggccactcccagaagctaccttatacagtttaaaaagggtagaggcccagtgtggtgtctcacgcctgtaatcccagcactttgggaggcgggtggatcacgaggtcaggagatcgagaccatcctggctaacgtggtgaaaccccgtctctacgaaaaatacaaaaattagccgggcgtggtggcaggcacctgtagtcccagttacttaggaggctgaggcaggagaatcgcttgaacccgggaggcggaggtttccgtgagccgagatggcgccactgcactccagcctgggagacagagcaagactctgtctcaaattaaaaaaaaaaaaaaaaaagccaggctggctcacgcctgtaatcccagcactttgggaggccgaggtgggacagatcacctgaggtcaccctgaccaacatggtgaaactccgtctctactaaaatacaaaattagccaggcttggtggctcatcgcctgtgatcccagctactcgggaggctgaggcaggagaatcacttgaacccgggaggcggaggtttccatgagccaagatcatgccactgtactccagcctgggcaacaagagcgaaactccatctcaaaagaaagaaagaaagaatgaatgaatgaataaataaataaaataaaaattaaaaaaaggtagaaacccttgcttccagaaactccccactccttttgcagaaaactcgtgaatagcctgtcctttatttagcatataatgaaggaatagacataaatatagctggccagcaatccacgagggctgccgctactgctctacggagcagccattttcctgcactgttgctctaataaacttgtgtttgctttgctctgtcttgtttgctcacccttgaattcttttctctgcaaagccaagagctctcccagtctgagccccaatcatcaaagatgattttgagggcttcagtatttaaaggggaaaagcaggctggaggggaaggagggaggggatggtcacattattaaatccgtatgttggaagagaaaaggagcagggaggggaatagtgacatattcatctagtgcttctacatcggcattttacacaagataaggtgaatgcagagtgtagatatttaaccttttatccgtggctctctgcttaggaacaaaaggagaagcagcttcttgcctgactcagctttcagcttaatttttttcttttggcagagtgaattgggattccaagattttatttgcctttcccatcatgcgattggataccacaaagcagtgaagaacagtgagtgcccatgtacttgacaatgaaggggaatcttccagacatacataaagcgaaggaaggcaggcaaaagagtgtgcttgtgtgatactgcctatttggggctctagaagaggcaaaactaatctatgggagtttgaggataatgttcaggataatggtttacttttggcaagtgttgtctgagaagaggcacttgggagccttctgggggctggaaatgttctgtatcttgagctaggtggtgggtacacaggcatatggcttgtcaaaaataattgagttagccgggcacagtagctcatgcctgtaatcctagcattttgggaggccaaggtgggtggatcacctgaggtcaggagtttaagaccagcctggccaacatggtgaaacccctgtctctactaaaaaaaatacataagattagctgagcatggtggtgggcacccgtaatcccagctactcgggagtctgaggcaggagaatcgcttgaacacgggaggcagagtttgcagagagccaagatcacgcaactgcactctagcctggaggacagagcaagattccatcttaaaaaaaaaaaaaaagaaggccaggagtggtggctcacacctgtaatcccagcactttgggaggccaaggtaggtggatcaccagaggttgggagttagagaccagcctgaccaacatggagaaaccctgtctctactaaaaatacaaaattagccgggcatggtggcacatgcctgtaatcccagctactcgggaggctgaggtaggagaatcgcttgaacccgggaggcagagtttgcggtgagccaagatcgcgcaattgcactccagcctgggtgacgagcgaaactccatctcaaaagaaaaaaaaaaagaaataaagacataaaagatacttggggctgggcacggtggctcatggctttaattccagcactttgggaagctgaggtggctagatcacttgaggtcaggagttcaagaccagcctggccagcatggtgaaaccctactaaaagtataaaaattagccaggaatgatggcaggcgctaatcccagctactcaggaggctgaggcaggagaatcgcttgaacctgggaagtgaaggttgcagtgaactatgattgcgccactgcactccagcctaagcgacaagagcgaaactctgtctcaaaaaaaaaaaaaaaaagttgagtcatgttgtgaatgtatttaacaccactgagccgtacacttaaaaatggtgaagatgttagattttatgttatatctattttaccaccatacaaaaaaattgagttataccttaaggtttgtggactttattacatgtcagttgcacttcaactgaaacatttagcacgatcgttgcccctggctcctgagtaatttttttcatttttcagacatgaggtctcgctctgtcgcccaggctggagtgcagtggcacaatcatagctcactgcagcctcgaactcctgggctcaagtgatattcccacatcagcctcccaagtagctgggatgtcaggcataataagctactgcgcccgtccccccaagtcattgcaaatgttctttgaaaataccaccttcaggccaggcgcagttgctcacgcctttaatcccagcactttgggaggccaaggcaggcagataacttgaggtcaggagttcaagaccagcctggccaacacggtgaaatcctgtctctattaaaaatacaaaaatgggctgggcatggtggtgcatgcctgtagtcccagctattcaggaggctgaagcaggagaattgcttgaacccgggaggtggaggttgcagtgagccgagattgcacccgcagcctggatgacaaagcaagactccatctgaaaaaaaaaaaaaaaaaagaaaataccaccttcagtggccacatattttcccatccacggatgtgtcctggtaccttcattcactctcaaatctttccccagaattgtgagaaccacagccccatgtcacagccccaaggttgcagacaaggtcccgacccacgttaagacgcaaaataatttattggaaggtttttcttagacccctgggaaggctaggaaacctggcttggaaagaaggaggagctcaaggaggcaggaagctgccccacagcctgggttaccccaggaataggctggtctaggggccgctgtaaccactgctgacactgtggatgtcaccatcagggacagtgccactctgggacgctgcggccatagccactgggaagaggtcccagtgggcccggattctttgtggaggaatctataggcctgagctctagaggctgggaaatggaggggcaagtctctggtccccatgctcaacaagaccccctcagtggggaattcctcattgcagaaggggcaccagatgcagggcagctaaacaagcagccagggattcctaccccgagaaatgtcctctaagacaataacagccagtatttgttgagctctcactgggtgccaggcccctgtgccaaacttcctacatggattatcacaaagaatactcacattagccctgtggggtgggggttattattatcttgattttgcagacaaggaggcaggcacagagcaatttggcaacctgcccaggaccacacgcatgaggagcaggaggcggcattgcattgggggcacctgtgtgccaggtcagtgcagggcactttgcagtcctcttagggctgagggccttggacactcagcaccattttccctgctctgtggctgcagggggctgcaggggctggaagcctgacagccacgtttccttgaagcccctgcagcagggttctgggttacagcctgtcagtcacgggcatttgcctgacacctggaaggctgtggggaggtgcagtggcaggcaggggtgggctttgccagatgtgacactttgccagtgacttctgggggtctcctggggctgaccagcccccctccgagtggtgcatgctcctgcaattcctccagtcctagtttcttttctttctttttcttgagacagggtctctttctgtcacccaggctggagtgcagtggtgcaatcatggctcattgcagccttgacctcccaggctcaagcagtcctcctgccccagcctcttgagtagctgggaccacaggcgtgcaccaccatgccaggctacaaatcctaacttctggaccaggtgtggctgcccctcagctctttggaaggttttgcaagcctcaaattccccgtgttcagtcctttcctgcttgaaatgccattttcccaactgaaccttgatgaggcagaggtgttaaggcaaagcagctgggcctataggcctgagctctagaggctggggaatggaggaacaaggctctggtccccgcgctcaacaagaccccctcaatggggaattccacatttcagaagggacaccaggtgtggggcagctcaacaagcagccagggcctcctaccccaagaaatgtccttctaggataatagccagcatttgccaagcactcaccggtgccaagcccctgtgccaagcactcaccgggtgccaggccccaggaggctgaggcaggactggctttagaacaggaaagctgggggtgcgagcccggctctgccagttctgtgggtttgtggttttttggtcgcttcatgtgcctgagtctcattttcctgtttcctcatttggaacaggcagtggtggcgtctctcatggggacgtggagataaaccagggcgacatcggggacacacaagcccagtgcctgcggcgatggccgatgaggcgctctttccatttcctggtagcagatgaggaaagtgaggctcaaagaggtgatgtcatttgccccaaatcacacagttgggaggtggtggggtgcgaattcaaacccaggagtgtgaagcttccagctcgtctgtttctccctggctgtgggtcagtgccctgtgggaggccaggatgccggtcagggactggcatggcagggtgaggggagcagggtgggccagcctgcctcccctccctctcctggggctgctgccctgtggagtaggggactgccatggccctcacctgtccaccttgtctccttgcctgggccttgtcagccctgtgcactccacagggcagggacagggcctgctgttgacagaagttcagaacaaggcagtgcttggccctgggtcctgcgcagatcagtgctggggctggcctggggcccgagctcaagcctccgaatccccttgcccaggctggactcttgctgcaccggggcaggttggcagaggcctggaggttttctctgggctgcaggttgaggcacctgggcttgcagacgcacgtctggcggtccagcttcctccctggcagcctctctcctgcgacagcaatatggtggtctgcagcttcaggccagctccattgctgcccatgaggctaccccagtggagagaggtcaccttgcctcagggtcccagctgaagtccccaggctgcatctcattggccaggcttggtgatatgttcatccctgaccagtcgcagtgcccggggggtgcgccctctcataggccagccatggagtaggctggggtcagaaaaggcctctcctccctgagccacatgaactgagaatggggaggtgacctttccagagagggggtaatggactctaggagtcagaagtagtgaatgaccctgacggggaaacgcaggccccactgtcgccagccctgctgatggtggccatcctttcttcctcaccttggcagcaggagctggatggagtctggggaggtggcaggtacatgctggagctcagagtgtgagagacagttgaggatggaatgttctcttggagaagcgagaataatgtctcctccccttctccaaacagcaagtgcccggcccagcctctgtctcaggaaactctctaacagccaagatcagggccttatggagagctgacccaaggccaggcactatgttggacacatctgatgagtcacctcacttcagccttgccaaagcttcatgagcacccatttcacagatgaagaaacggaggctcagaaagacaaacgtttcagccaataagtggctgaatctatgctcaaacctaggtctgtgtgatcccagaccctgaattctacaagtccaccaaaaactcctctttatcttcttttattttttatgtatttatttatttttagacggagtctcactctgtcgctcaggctggagtgcagtggcgcgatctcggctcctctccgccccatgggttcaagtgattctcttgcctcagcctccctagtagctgggactaaagacgcacgccaccacaccccgctaatttttgtatttttagtagagacggggtttcaccatgttggccaggaggtctcactctcctgacctcgtgatccacccacctcggcctctcaaagtgttgggaatacaggcgtgagccaccgcaccagcctatcttcttttaaaaacatcatcagtccaccctgggtaatatggcaaaatcccatctctacagaaaatacaaaaattacccaggcatggtggcacatgcctgtggtcccagcttcttgggaagctgaggtgggacgatcacctgagccctggaggttgaggctccaatgagccatggtcatgccactgcaccccagcctaggcaacagaatgagaccctgactcatgatacataaataactaaaaatagccaggcgggctgggcgcggtggctcatgcctgtaatcccagcactctgggaggccgaggcaggcagatcacgaggtcaggagatcgagaccaccctggctaacacggtgaaaccccgtctctactaaaaatacaaaaaaattagccaggcgtggtgacgggcgcctgtagtcccagccatttgggaggctgaggcaggagaatggcgtgaacccgggaggcagagcttgcagtgagccaagattgtaccactgcactccagcctgggcgacagagaaagactccgtctcaaaaaaaataaaaaataaaataaaataaaataaaaacacataaaacatcatcagtgtcttgttaaagtagtgctgttctagttgtaaacgagttagtgtgaggttgtgggccatgtctgaggcctcagctctcagcccaggaaataaggctgttgtgagtgagtaaggtgggggtgaaggatgtgggaggggggctctacttccaaagttgctgaggcagtgttgaaggccgcaggacacttcctcaccactgtggcccaactcttctttctccctcaaaacccagctcgaaggacacttcctcccagaagtcttctctgctgtgcctataaccctcccctgaccccaggaagacacacacacacacacacacacacaacttctctgtgtactccatcccctacgttgtactcatcaaagccccaaccatagtgtgtgtgtgtggtgtgtatggtgtgtatggtgtgtgtgtgtgtgtgtgtgtgtgtgtctgtctgtctgtctcctcggtcagactgggacaacctgagggcaaggagagggaattccctgatgcccaaggtgtgccccgtgtagatcatggtacagagtggaggctcagcaaacagagcataaatgaatgagtgagtgaatgaatgcatggaatcttggggtgagtttccctgaagacagccccagggtgctgtggctgtaggagctggaccgtctagtgccttggtctgggggtggctgaagctggaggagggaaagaggccagtcctttgcagcttctggaggccagagtccaaggtcagcttctctcaacaggacccctctgaacccggctgacaccacggcctttggaagccatgtggtcagtaacacgctgtcacccttactgcagtctgttcacctgacctaatgactgggaacctcaggtctgtgactcaatgcccagaatgctgtctggtatgggggtatgggtcacacctggctcatctccaggacagccctgttctgcgtgtctgccagccaaggggtcacgtgctaacctggctgccccactgggggtgggaggggcagcttcaggatggggccgcatcaggccccatctccctaccaggcccgtcagtgggcaccctgcgcctctctctctcattccttcttttgagcctgcagcactactccccgaccaaagcacactttcccttctcgtctggaggagagatggggcctcgtgccagctctgcccctgcctgacacacacgcttggcccgtcactgagcctcagtttccctctctgtatttcttggctgtgcaaaggcagtcgggggaggctggccctttaagctggatgaggctggtattttgtgtttttttttgagacgaagtctcactctgtcacccaggctggagtgcaatggcgcgatcttggctcactgcaacctccgcctcctgggttcaagtgattctcctgcctcagcctcccaagtagctgggattacaggtgcccaccaccacactcagcaaattttttgtatttttagtagagacggggttttgccatgttgggcaggctggtcttgaactcctgacctcaggtgatccgcccgccttgggaggctgggtttttgagctttgtgctgttggggcccagccctcagggccgcgtgggaacccccggggcggggtgttctataccaggaagtaggcagagggccagcccgaggacagttcgtttcttgccagtcccctgacctctcttggcacacagcctgtggcagcagcaggttgaagccagacgctgctcagacctcacaccacgtcgtttgcccaacccagagaaagctctgtccccggcttctggctccttctctgccaggactcactgggtgtgatgagttggtcttggggcactgtctgggcacagcctgtttgcccaacatggcctcctgggctccatgcttccgcaggtgggaggggtctggactggcccaggggctctgacagcggctggcaacctgaggttttgacttcagggtgacctgaatcctgccgcattatggaggctggagtctctgggggctgctttcccagagaagaagctccttccccatcagcctgacattggctccaaggactccatgtggctggagggctcagggctaaggggagggaagccccgggatggcagtgaggggtgagggaagatttgggaggtgacatctacaaagagacctgagcgggtggggcaaagagggggtcccaggcagagggagaagcaagtgcaaagaccttcataacccaggggagcgctgagaccaccgaccagcagcacccccacttcttcaagccaccactcctcagggcctcccaggggtccccagcctggagcaccccatgtggtagagctggtaggctgggggacactggggactgctgtcccacttggagcctcgggctactccgcccaggagcagcgatgtggaaccttgttggattttcatgttcccaaacatccaggagacacacagttgtgagtttccagccaggcgatctctaaggccagagcagcccttgtgggtgtcagtgaggaagggcagaaagactctggcctcaagctcagctccctgctgcagggagttgaacgcccctttggtgagtggctctagctaaacaaacacgtgttatcatctgtcaatagcggccacctccttgctggctgggctgctgctggctcaaagcccagagcagcccttccggggcactgcctgccacagccaacagtcagggaagggcagctactgccctgggttcaagcccgggctacccctgctcctgctcactgtgtgtccccaagcaagtcactgtccctgcctctctgtacagtgggaggcctggatctctctgctctgggaagacacccagccctggaatggttgggccacacttggggctgggggccaggaggaagttggagggctgggctggggctggggctgattagttgaagccagtagaaaagtacaggctttgctattagattccaggaaataacaaaagctgctaacagttaccgaatgcttaccacgcacccgacgtggtgctcacgcatcttttgctgttttatttcatccttagtgagttgggtactattatcatctccattttacagagcagaaactaaggctcagataggagacgctgcaaaatcaggaggtggtgaagacagaatgtgcccctagggtgctgatcagggccctcacctagaggcagatgcccccatctcctaaggtcaatggtcctcagctatcatcccttttttttgttttttgaggtggagtctcgctttgtcgcccaggctggagtacacgatctgggctcactgtaagctccgcctgccgggttcacaccattctcttgcctcagcctcctgaggagctgggactacaggcggccgccaccacgcctggcaaattttttgtatttttagtagagacagggtttcaccatgttagccaggatggtctcgatctcctacccgcctcagcctcccaaagtgctgggattataggcatgagccaccacgtccggccagctatcatccccttttaaactttctggactggccacgctgaacttctcaccctcctttccataagacaccctgtccttccatgtctccaggactttgcaggtgtccaccgcctctgccctttgggcttatgaactcctattcatctctcaggacccttcttaattttacctcctccatgaagcctgctttgcttggttccccagcagaaacagggggcactctccttggtcctcctgccacgcttcttccacacatgcatcctggcaattaccacattttactgatgttcgtgtgtgtttccctggagggaaaggagtgggtttcaatcacccccatatcccctgtgccttttgagtgaccagccgttattcggcactcaaatagggaaggctgtcaggggagcagctgactgcagagagactgccttggaaggaggagaggcccgggggtggagcggaggtttcgggtaaacagaggcggcctgactgacagaggggcatcagtcaggggaaaatagaaccgggatccaggatcgtctgagtacgcagctgagctggagaaggttgtaatgaaggcagtttgagcaggtgtcagctgaggagggcagaggttaggggcagagcagggcgcatgaggtgtctggggtgcacccacagactgttgaggcaggacacgggtaccaactgacttgggtgccagacccatgtgaagggcacgatgggcactctcctgctgaatcctcaacaaacccagagcgctttcactccctctgctttacaagttacaaatctgaggtttgggaacaagtgaggcagggcaggtgccccccaaccttgccccaggccaagtgggtgcctgagtcaactctggtccacttggatgacagtcatgtgccaccacacctagctcagcctccccagcttgccgcttaccgcagaagaaaaacatggtttgactagcaagaggaggaaattagagttttgtgtatagaagagtcactctgggccgggcgcagtggctcacacctgtaatcccagcactttgagaggccaaggtgggtggatcacttgaggtcaggagtttgagaccagcctggccaacacggtgaaaccctttctctactaaaagcataaaaattagccgggtgtagtggcaggcgcctgtaattccagctactcgggaggttgaggcatgagaatcgcttgaacccaggaggtggaggttgcaatgagccaagatcgtgccactgcactccagcctgggcgacagagtgagactctgtctcaaaaaaaaaaaaaaaaaaaaaaaggaaaaagaagagtcactctggagaacagctaagtccaagactcctggcctgtagcttccagtcacgttctatcagtgctcaacttgccatccccactgaggctggtgtgatgaaatcaaaattacctgaccccggcctgctgctcagggagtaaccacactcatgaagagtggcaaaagtgtaacgtgctttgcagacgtgcttatgagatgtaaattgcctttcggtaaatagaaccctgcttcccattcatgtaattatagcttccagcctctgccccatgagagaaaacacttgtcctgaggggaatcacagtaataatttagagaataacacaagaaaccttctcctcatcaaatgcagttattcctttgccccggatgacatttctgtcaagtcgctattaaaatcaccaagtccaggctgggcatgctggctcacacctgtaatcccagaagtttgagaggccgaggtgggtggatcacttgaggtcacgagttcaagaccagcctagggaacatggtgagacccccggcccccacccccatctctactaaaaatacagaaaattagctgggtgtggtggtctgtgcctgtggtcccagctacttgggagactgaggtgggaggatcgcctgaacccaggaggtcgaggctgcagtgagccaagatttcaccactgcactccaatcttgggcaacaaagcaagaccttgtctcagaaaaaaaaaaaaaagaaagaaagacaggaaaaacaaaacaaaacgaaaaaaacactaatcgtcaagtccagcagcctgcctggctggaggaaacctcggacttcctttgctgtctctaggcatgctccgctcccctccagtttgactcaccctttcagataacaagaggcctgcccccatggagtgcctgagggccagcaaacacctgtggcttcctaggagcccgtgctttgggcagtggcacctctcccacttttcaagctccctaagcatatttgacagtgggcgtggatcaccccacttatctggggcataatctttagacagacttctcctggccccacataactgcatggaaagtgggtagaaagcaatgattcctatttttcgcccatagggattcttttttttttttttttttttttgagacagagtctcgctctgtcaccaggctggagtgcagtggcgtgatctcggctcactggaacctccgcctcccaagttcaagcgattctcctgcctcagcctcccaagtagctgggactgcaggcgtgtgccaccacacctggctaattttttgtatttttagtagagacagggtttcaccgtgttagccagtttggtctcgatctcctgacctcatgatctgcctgcctcggcctcccaaagtgctgggattacaggcgtgagccaccgtgcccggccttttttttcttttaaagagatggatcggtcttgctatgttgcccaggctggactcctgggctcaagtgatcctccagcctcagcctcccaagtagacccacaggaatgccgaggagacagagactttcagaatcaccctggcaaaggtggggctgcgcagctggggctgggggtctctggaacactggcagctctgtggtccttacctgtgctctctagatatttgagatgagcctgggcaatatagggagaagcctgtttctacaaaaagtaaaaaaattagtggggcgtggtggtgcgcacctgttgttccagctactcagcaggaggctgaggcaggaggattgctcgggtctgggaggtcaaggctacagtgaggcatggtcacaccaccgtactccagcccgggtgacagagtgaaaccctgtctcaaaaaaacaaaacaaaaacaaaaaacaagctggtgccttggagcctggggttaatgtctgcctctgtcacttgccaccagctgcacaatctcaggcaggccgatttccttgtttattaaggccccagagcaccaccaccctgagtggggtattccccgttcgtttccccacaggcccagtttctgtatggctccctgtatggagtgtggtagccccccaaggcatgttgctttgttccctgagccccagaagcctgcactcactggaagtccactggaggcccaccatgaaggttgtctgccatcctcttgggtgacccatgccatgatttctcacaactgtgaccactccactaccagggtcccgactaggaccttgttctcacaggaaagtgtggcccctccagagctctgagcgcctgttctccgcctgccctccacacttgcttactgctccaatgcttggcagtcctctgcccacagggagcctccaggattcaaacacctccaccttcacctgtctagtgacccactcagctcacagacttgccttttcttccctaacctgcaggtatgcacggcttctcatgcaaccccttctcctgccaacctgaaccctagggcccccagccctgctgtcttctgtggtctccacctgggtaaaggcccacgtgtgcctgagaggctcacacctgtgcagggaagtgctggccaccagcctgggctcaggacactgacctggtaccttgaaagtgatgagtagatatttctttaatgaatgataactaggtttctacagtcagcatgctttcccattctcaatttcaaacctccttcttactcctcaaacctcctggccctcctgtcttcactctcatctgcctcctacttaccagacaagagaaaacctcactctggactggctccctcaccacatcccaaatcctcttttcctcctggaaggaagacggatctactctctgaagacccccctgaggccctactccaagtaactccttcactttctttctcagaacacacttactatgcaagctccccgcctccaagattcaacttgggtctcctattaatgaaatgaacctcctcccttcccagtggtcatcctctctcgttcctccttcacaaactttgcctccaccctctcaacccatccggctcttccttgaagcactgacataagctcagctctccgaagtcgaggaccaacagcgggggagcagcctttcctgccgcccccaggcctcagtgagggtgggtgcaggggctgccctcagccagctccctaggctagctcactgctgtggtctgagcatggccccaggttcatgctggaaactcagcccccagtgcaacagtgtgttgagaagtggggtctaagaggcaattcggtcatgaaggccctgcctcatgaatgaatggattaatgccattatcgtgggagtgggctcccaatagaagtcaagccccttcccctctctgcagcacgggacgatgcagcagaaaggtcttcctcgccagaatcggcccctccatcttgaacttcccagcctccagaaccatgaaccaaacaaacgtctattggttctaaattgcccagtctgtgatattgtgatagcagtacaaagagaccaagacacccactctcatggctttgattttaccccacattgaagattcaaatcttgttccctgctccaaaccccaagaacgtactaggtgctcaaacaacacggaagtgcaccttcactcctgccacactgggccccagctgctcagggcctcacactggttccagcggtctggtgtgcctgagcaggcccagcagcgctctgcctcccttcagccagagtagactcaacaaggtgggctgccccaaaaagacctaagtcactgtttactgcaagtcagctgaaaaccccacaaacctggcaaggaggacgcgggatctggcaacagatctggctttttcagaacattaccaaagcaatctctacgggcctgcgtctgtcttctgtcctccagattagcagctttacaacagtttccatgaatatgtgttaagcttaacggcctgggagaaaataagtggcagatggtggaggcagtgttagtgagcgaccccctttcccagtcttggccattcacacacactgcccctagcaatccctggtacccttttggaagaatccaaatttacttttcagccgggcatggtggctcatgcctgtaatcccagcactttgggaggctgagatgggcagatcacttgaggtcaggagttcaagaccagcctggccaacatggttaaactccatctctaccaaaaatacaaaaattaacccagcatggtggtgggcgcctgtagtcccagctacttgggaggctgatgcaggagaaccgcttgaacctgggaggtggaggttgcagtgagtcaagattgtgccactgcacttcagcctgggcaacagagtgagactccgtctctaaatcaataaatttccttttcccctgggctctatcattagcaaacacaagtaatgcccatgtgctctaggacatcagggagggagtaaacctcaccttcctttgcatgcgagggtcacacgtgccatagtcacagggagtgccctggagctggcaacttgcttgtactctgctctgggtgcgactgggttctgcagcagagtacgcaacggtgcagcaggtcagtgacagaaagttgacatttgagaaacgagtcacacaagggctcccggcaagttagctaccattggctattggaagagtagagagaaaacctgagatgctgaacaagactcctaagtacttaacagacatgccacgcttagcctttttctatactgggaacccaagtttgggtggatacttcaatcaattaggaaaaatcaataatcaatacttgactagtcccgtgtgtgcagcactcacccagattatcctcatgagtgaatgcagctcaaccagaaacttaactgatgacgggaccaggcgtccacactgatctccggcacagaatgatgctgggtgccaggaaagagatgtggagattaagcagcttgctcagggatactcagatgttgcaggtttcctctctcctgtacagtcatatttcaacagtaaatgggtgaaaaaaggacccaggccagtcatgagtatgctaactttgaccaatacggagaggggggaaaaaaacaactccaagtaatcaggaactattaatgcatttgggttgcaaaagccttcgatgttattgtgctccatgttgagggcaaacatttcttgggttcaaggactaggaaggtatgtagtttagtctccctactaaaagaagaatgtatgtttaccctctcttctcttaaaaatgagtggcaccagacacaagagaccagggcccagagaactcaacactcacaggtattgaaaagctttagaaattgattttacaaattgttttacatgaaaattttgtggagaaagtcaccactttgatcttttttttttcttttcagatacagtgaacaccggccaaattgttttaatttccgaatttattaaaatgattaacctcaatactgcaagtgcatgtacaaaatatttgtaaaaaatgtttttaatgaaacgttaaagaacttacctcaaatgctgaaaaagtcctttttcattctttcagtacaaggaatacattgtatctcaaaagtattacaactcagcaaaaacaatttataacagtaatttgaaaatgattgaaaattgaatactttacatatatttctatgatcatctcctaattcttacaatgccaaaatcttaaccaatcattgcataagctcaagctaagagttttattgaatgcaacctcttctaaactggtcaacggtgtgtggctgtcaccattccacacggtgaagttctacagcagatccggaacagttccgaggcccctacctttaccaacggaaattaggtttccctagaaggcatcaacagtggctgctgagtgcttgtgcataccgactcctgagaggcagtgatttactaccaaatgtcactgctttgagacccatgggaaggttggcctccaaagaggaggccatgataaaattaaaacatcaaaaataagttactaaaattcagctgaaaaatgaaaatgggaaatgtgttttgtcactttttaagatcgaaattcccaaaatagctatcgttggtattcaaataaggtttaagatttagtctctgaacctcttcaaaacaccccaaactaaggtgggaatacaagaggtgacccgctgccctccagcacctccagacacagggtctaccttcatcttcctcagtggcaggggttcacatttctatgcagggaccccatgagggctggacgtgctctgcaaagtgctccgggtgcctcggacaggtgctcctgagaggctgtgtgggctgccctacttcactgttgaagacctccagacgcagtgaacgggggtatgggtgggtgtggaagaaggtctaccacatgctttccaaacgcctgaggagttcgactgcaccacaacaaacaaggatgagactatgtaagactgcagaagtagttccttagagaaccaggagaaaacaatctactttctaaaaatgttcatgagtcttaatttctatttggaacctatgggcaatcaacagtcttaaggagcgtcattgaaacaatatccccccaaacctggaaactagtaggaatcaattagtagtaacagtaagcattgagattttctccactggacttttcatgaccttcagattccttttcatatttcaagacatgggctactttcctatagacactatacaaatcccctgaattgatttttacttaggaacactgtatatcagaaagtacaggtacacatttcccagaaataaagagacctactggtgtcaaacacctgttacagatttatattcccaaattctctgtccaatgatttgcaaaataatccagagaaatgaaaagaacctggtattgaacataaagtagtaataaaaatttgctcattaagttaattaaaattaatttctcaaagtgcttcaaaaaacaaattaaatctgactcctttttgtttaactgataatatagtcaaaaaaatctttgatgttttcataataaactaacataaactaacataagccaagaactcccactgatgcagtgcttaaaactatatatttataatttcctattttattggcatgaatatttctaaacttaaaaaccttcctggtaagttcttttaatttcttatgacaaaaatttctcacaacacacaaatatttacaacatatacattgttttcagttctttacattgaatctcaaagacaaactttttttataggttaccacagaacaaaagctgtgactcatgtttttatttcataaactattataagttaaagtgaatagatttttttaatattccttgtagcattttacaagtgcaacagaaaacttgaagaaccaaattaagatagctgtagttcattagataaatgttgcttgttgtcatcacgttgttcacagcaaatttttgaaaaaataagcaccaatcattcttgcaaagaacaattttatctaaaaggattgaaaagagttaaatacaaggtttttaatttacatgacaagcaataaatacgctgtatcgaacctcatcccacacactgctaccctcgtacatatcatgaactgaaaagtgagctgtcacgtatgtcgttttttttttttttttaagaaaccaatctgactcccaaccaatggtttgcgatattaacaaaggccacaaacagtacacctgggccagcaaacagtgtgaaactgacaaaactccaagggggaaacatctagcaaataaatcaaaaagccaaagatcattgctggtgatattagcatactagaaacccttaatatgctgctactatgatttgttttaaattattgtttagtcatatattaaagagccagctgatgctcttacagttaaaaaaactgtgtagccacattactgttttcaacgtcctgtgtggaaagttgctatcactgtacaattttgcttgagcctttattttacaacagggctttacctctaactcagaattgcacgtaagaaggctatttaaaaagtacgataaaaatttgcacaaatcagacttaagaattgagtcagtatgctgtacactttctacaatagtatgctgataagtgaagggacaatagaagtgctgccactaaactttcagttgaggaataattgactggaattttttatttctttaaagtagttatcccaggtcaagttaagaccaagagcttaggcattaagccttaaagactgatcttctcttctccttgaagaaatgtcaatatctatagagtcttttccaactattaacctcaagcgcttagctggaggaagaggaataaaatcgtcttcaaagtcatcatcatagtcatcctcctcttcatcgccctcagaagaggaggaatcatctgtactttcttcctcatactgactatagtcatccacctccattcgagactccaagagagaaagaggatcactgcagcacaccccattttcatgaagcccctctgtataagaccccctattttcctcatctcgttttagctggatttttaattttgtagaactactgcctgatcctgagttaaatccattattaagctttgctacatagagattgttatcgttgtcatggtctttgcttaacttgatgcttattttggaagagttcattccatcattctcttggtcatttgttttgctgctgctatcatgacgcctacgaagagtcaatttgggaatcccagagttattttctaggattaactgtgcatcataccttgtgattcgcctcttctttttactttttgcagttctaaagctgtcttttgttttgaagctatctgatgtcacaactgaacaaccgacgggtgaaggagcacagtctgtgtagctcacaggcacgcccacagtgccactgtgctcaccctggtcagaatggggacccatcaaatctggtaccgcgtcgtcttttccaggagaatcgtgcactggagtagattcctctatttttgcaaactgtttcacaagttttccttgtcgtgacttctttttggacatgcctgtgtcactcttatgacactttgcctcccctttttgtgcagtctcatgagccagttcttcctcctgcagcacaggagctggctgcagctgttcaccactgtcggggcaaggttccgtcacactgcttttatagccattcaacgtatttggttcaagcttgatgtcagaggcctccttcagatttgttcttgtcctcactgaccgccgagttatgtaggtgcagggcgagctctccccctgcgaatgagcacctctcacaggattctgtctgtgttctctcgccgcgtgtctagtcaagcacccgctggcaactgcggcttgggctggtccctctggctccttatcttttttaatgggcaaatttttatacagaactactttaggctctttcagtactaagtttcccatttcgagttttcttgaagcattcttttgctccagccgcttgcaatgatttctcaattttatctttgaaagtaaaggctttgcaggcttcttcagtttctttggtaccctggaattatttatatgagttagcttagatgaggtagagttggaagaagctggaattcttgacatagattgcctcgttaacgttctgctcttgctattcttttttacgccaactgaagattttcggttagaagctgtaaggttaaagagaaaaaggtgaaaagccttggtaacagcagagttcaagaaaagaatgcccaaacccaggctattagctacagcacgtttagattacacaaacgccaacaccacggctcctgctgcagattctgccagcgcacctgcattccctacactgcttctctttgaagttcttttctaatttatggggcatctattcatttttgaggtaagtagttgcacggttaaggagcttttcacagcagggacctagattccactctaagcttcttaatctgtcgtgacactggcccaaacgaacgctttcttctcctgatttagtagtttcccacataaaagatttcaaagaaagttaacatggttttttcctttcacagattctccttagtcatttaaaatgtttctaaaatccattgctcattaacctaaaggaagtacagcacttggccattaacatagagtagaaatagaatactcatgggctctaaggaacaaattctatcgcaatggtttcaaacaagaaaaacagatgctaagaaccatatattatcactctgaaaagtacagtcactaccgaaaaagaaatgcactattctaagttgtccccttcaactccgtgaggaacagaagaggcaaccagtgggctgtcaacttagaagagctgcaaagcttactcagccccatcccttcagtgacggccagatgccaacaatcacagtgaaggaagatgcacgctgctagaattgtacactctcaggacaaagggagatccaacttctttcctccaaggccaggatagaaaagggttacaatgaccctaatggtaatgacaacctgagtagtgatgaatatgattccatttgagaatgagtgtattcttatccactggaattatacagaactactaggtagaaaatattttttaaaatataaggatatttagataattcttttgctacagaatttctttatgcttacgaggcttgcctacaaggtggatcgaatagacgtgctgtcaatataaagaataaagttgaatggcttctcaaaaggcttcatttgtgactcaagcttaagctgctcctgtagtgtctctgaccttgccactgactttctgctatgttaatttttcctctgtattgacattccagactattatttatagaagttgttacacaagtcagtttctcaattacttagttcttgcaggtccagttgaaaaacttcttcctaatcaaaacactccatttacagattcactagagaagccacgataacaaaacgaatcatcaccacctctcatcagaacagggaggataaaaacaataaaacatgggtaagctcagcacactgcccaaccaagtgaggaccaggatcctgcagagaaatctgtcgctttctacatgcctcaggttgccagggcaactgccattccttccgcccagctaagcaagtaagttaccataagttcagtttttattgagagaggagcaagaatgcatcacaacattccaaaaatatcaaaccaccaagaatagaaggctctgcacctgaggtcaggagttcgagaccaacctggccaatatggtgaaaccctgtctctactaaaaatacaaaaattagtcgggcacggtggtacgtgcctgtaatctcagctactggggaggctgaggcaggagaatcacttgaacctgggaggcagagtttgcagtgagccaaaatcgcacgattgtactccagcctgggtgacaagagtgaaacttcctctcagaaaaacaaaaacaaagaaggtcctgcacgcacagactggctcataaatggcttcagggtacataaaccagcagaattcacagcaaagggattcacagtttgaaccaagaacatacttacacatgtgggctgctaccaaggtggcgcctctttttagaatagtaggagtagtgaactttgaatgtgattcaatttgagaacgagtgatttattatccactggaactatacagaactatgtgatagcaaatttttttttaataagaaatttagaaaataagaaaaaatagggaactcttcggctaaagggtttctttatgcttgcctacaaggtggactgaatggacgtgctgccaatataaagacactagtgaagaaaggactgcactgcttggcttccctttgcttggctctctcagatgtggctacgatgatcctttgctcattctatgcctcctcaaggactaatttatgaccaaacttagtggtttccaacctttgatttctcctctttccattccactctcatgacgtacctgcaagcacccttacacaacactcacatctatgtcatattctcaacagcaatccccgccatctggatccagcctgctcctccaatgagacagcctttggtgatctgacaacttcttgtcgtcaaacccagcacacactcctcagcccttccctttcttcatttctctgaatgtgacactgataaccactttttcttgagaaaacctttcttctcttggctgtcaaagagagcgcactctcctggttcccttctccatccctggcaccctccttcatcggccccttagactgttcttcttcaggtctgtgtagtcctaggccccaggtgacaagcacccattctcgcacggctattaccacttacaggctgacagttcccgaactctggccagacccgctcctaacttacagaaccaggtcaccaaatactgactgtctctaagcccctaaatggaactcaccatcaagtctcctgacgacgtcccctttcgaggtctccatcttggtcaatatcaccaccacatgcccagctgccaaagcagaaagctggaggtcctccttgactcctgctctcctgaactgcctcaccaagccaatcaccatgtgccgtggagtccacccctgcaatgtcactgcaacctgtctactcttccctgtctcgaaagccacagcctcctgcatgaactatggcagttttgtttttcctattgttttcccaataatccgtttaccaccacatagtcaggatgactttcctagtgtatcatgcagcttctgggctttaaacctttcagcaacctaatgccctaagaatgaagtctagaattttaacctgtgctcacatctcttcttcttagcctgtactcgccatgaagaaaagctttgactcaaactcccctctgtctatagagctgtctgaaaggccctctgctttgaataggcttcacttggccaacttctcatccccctgtaagactcagcttaggcaacacctccctgagggagcctctcgggactttctctgcaatgcctttcctatgtcttctcacagcacccaagaagctccttccttggtacttcttatttttacccgttggatgactcccattttatggtgattctgaattcggctctccccatcccatccctccttccaaaacattcactgttgacaacagaaaaccaaagcacttttatgtgtttgtctctaaactaacataaacgctccatttttgagcacaaaatgggtatgtatttgatgctatgtattacatcaacacagagatttcacttacatgttaccaatgtattctaattttgtttgaaaagcattatctcatcaaaagccctgtcaaaaggtatgctcatcaaatcaaaggaaaaaaaagacaggcaaagaatttgagaaatgtgacaaagatgaggacccagtagagtgacaagagtccttcactgtccaaagaagctgcactgtcctggcaggggttgagaatttcagacagtgaaggctaaaggaggaagacagtggccacaatgacaaactaaaagtcaatgattttaaaaagtccatcaagaaaccaaggactatgacctaagtggggtcagatgcacctgtgtttgagcttgctgtggcacttatatgcctcgtatgactcttcccctaggggctgggacaaatctcaaatacatggacctggactgtaattttaggtgggggtacacattcttctcagcaattactacatgctaggtgctgtgcaaaatggccacattcatcctaatgaacgccgttggaagggaaagcgattaaagctatgtgaaaaccaagcttacacgaactagcatgcctaaggtcatccagctggtgaatggcagagatgggacttgttaggccttcctgagcattaaaatcacgcttatgctgcctataaggcatatacagaagaattatggtgttggcctcaacttacgggtaaaggccccactgcatggctattatggtcatttcagggtgtcctcaaaatcataaggcagggtggcacaagacttccagtcagacaaaagagctgtgaccgacaccaaagccttcctgagcactcaggccgcactggaaatgcacaatcagcgtgaactaagataatacaagggccacagctgagcatctccagagctggaggatccagaaggcctctgacaggactttaaagacctcggtctcaaggagtttacttggcacaagcagctttcatctgacatgactagcacagactgccaatggctacctggaacggggtgttagaatttggaagcagcccgaaggctcagcagaaaagtgttcagatcaactcttgacatgagtgacagggcaggagtgaggagcagcgccccagcctctgcatctaggacaggtgctccatagttaagatcaacttctccctctggccgattcttctggggcttgtcctgacttgtggcacctgcagagacccgtgtccgcatcttcacagactgctcgcgagcctctctctggtctcaccttccctatcacagcactaacttcagagggggcagcccagtcagcgaggcataagaggcctgaaaaaccagaatcctccagtcctggcattctaattcagacctgtggactggatttgtgaaaacggattccttgttgtctctacttctggatgctaaagcaaagtcacaccatagctctcaaggtactttccgaaaaagcacctgtatggaaatttttcttccaactactcagaacatttttttatacatgtgttcaaagaaagcagttcctctatcagctgctaaattctaaacgaaccacatgataaagatgagcagccacacagaaaaagcactccgcaaacacatacacagcacatgcacccaccaccctgggaggagggactggcagtgctggctttcctgcaggatgtggcttccagaacctttctttcagacaggtggaggggatggctgagacaaacaccaaaagaaatacagcctaagagaacgcatgtaagaactcaagaaatccttatgtgaacatgacttaacatacaatggtctcagagacaactaaagccttgagctccttcagagagagcactgagccatgcctatccactctgcccatgacctcagagttagtcatactgatccttggattgctccaatcatgctgcagaaagggaatttgaataagccaagcaccccaatatcagcagtccctgcaaaatgtacacctttcttctgtaatgctgagacttcagcttaaagcgattattcagtccctctgaacttgaaagcctgtgcctccagtttgttctgcttacttgtgcacctgtcttatcctggagctaagtaaggcataagctccctgaggaaagggcccaagtctcaaacatctttgtatgtcttcaagaactagcaggatttcagtaagtatttagtttgttaatatatattcccaaatatttggtttaataaatattaatagttaaatattagtacacccaacatcttccaaaaattatttgtattcttatcttttaaactaagtagtatattgagttcagtagctatacaccagtaataaagttactacttaagcataaaacacctacatcacatagccattcaacataggcaactctgtggctgtctccatatacagatggcagcacgaacctaagtgtttttgtttaaaaatcacaggtctctggccgggtgcagtggctcacacctataatcccagcactttgggaggccaaggcaaggcggatcacctgaggtcaggagattgagaccatcctggacaacatggtgaaaccccgtctctactaaaaatacaaaaattagctggatgcggtggcacgtgcctgtaatcccagctacttgggaggctgaggcaggagaatcgcttgaacttgggaggcagaggctgcagtgagctgagagtgtgccactgcactccagcctggggacagagcgagactccgtctcaaaagaaaaaaaaaaaaagacacaggtcttactatgttgcccaggcaggtctcaaaactcctaggctcaagtgaccctcccacctcagcctcccatgtagctggggctacaggtgtgccaccatgcctggcttttaagtgtttttatgtctgcatttataaaatgggcttcacaagtctccagtttcaccaaggaaccagactcagaaaacaaatggtcgttatgctgcatttattatgagaatcaacagtcaacagttaatgattgactaactcttgttgttcactctggacattaacgaaaaagactggaatagggctacagcgctgcttttatgctacacgggttatgcttggactctgactcccagcagcaggtagattcaggaattcatggcagtgacattcaccatcatgggaaacaccttcccttttcttcaggattctctgtagtggaagagagcacccagtgttgggctgaaaacatctgaaagtagggagaagaacctaaaataatcagtatctcagagggctctaaggtgccaagaagtctcactggacatttaagtgccaacaaaggcatactttcggaatcgccaagtcaaaactttctaacttctgtctctctcagagacaagtgagactcaagagtctactgctttagtggcaactacagaaaactggtgttacccagaaaaacaggagcaattagaaatggttccaatatttcaaagctccgcaaacaggatgtgctttcctttgcccatttagggtttcttctctttcctttctctttgtttagtcttcgttctctttttcagtttccatcagatcttgcccccacacaccactggaatctcagaggttgcttctttctcctttccatctttactcctactttctggagtagccaatacagcatgtcacaatacggcactgttcaaaatgctcctctatcacaattctgagtctggtactggtggtctgctgaactgagtcagttcgttttgaaaaaggtcagcaagcaatgaaaaggtggaagccttaaggccagaagctatgaattccccaagtccatcatcttttctaacaaactggctaggcactggaatgtatagagtctaatttaattctactcagtccttttgtcttcttgcaggacttagcgacatcatcacagtctctaacaccttgaaaatgtttaaaacatatgatgaccttggaacatatgatgaagaactcatatccagttaccaaggtattcaagaaaaatagtctagaggacggtactgaagttagagatgggatacagactgtgcctctactcaaatcacgtctagagccttgaagtgcagccaaagctcacaagtcccagtctctctgagtatttaaaagtttaaaactactgaagcacactttataaagcaaattgtgtgaaaatacttttaaaagatatgcttatcaaatctcccttacttacttgcattgtttttttcctgagtggtatctgcatcagtgttagagctgacagattgactgtctgaatttttgctgctgtcacctaactttttaagcctatttaaacgtttatctgtttctctgagtccatatttgctattgataacaggagcaggcgcaggcagtcccactctggatttaaaagcaccagtgccccgtctgaaagagaaaatagcacaggttaaacaaatagaacacactttcttataataagcttaactgctgagggtacttggctacaggttaacagatgtgatgagctgctgaggccttaatcaccactggaaaccgaagactagaactcacaaaggaaattaagtatctatattataaaattaactttaaatctatatttaaaataataaaacaacttgttatgactattatcaatcattaattgcctatgagaaactactggaccttgtaaaattttttccttttttttttttttttgagacagggtctcactctaccgcccaggctggaatgcagtggcacgatcatggctcactgcagcctcaacctcttaggctcaagaagtcgtcccacctcagcatcctgagtatctgggaccataagcgtgtagcaccaccaccagctaatttttaaatttttttttgtagagatggggtctcactatgttgcccaggctggtctccaactgctgggctcaagggatcttcccagctgggtctcccaaagtgctggatttacaggcgtgagccacaaagtccagccctttaataaacattgccagattactttgccaaagggatagagcaaatcatggtcccactagcatggtgtgagttcctgcttctccacatcctcatcaacggtacattgtactccttaaattttaccaaagtgggccgggcatggtggctcacacctgtaatcccagcacgttgggaggctgaggtgggcagatcacgaggtcaagagataaagagaccatcctggtgaacatggtgaaaccctgtctctactaaaaatacaaaaaaaaattagcccggcgtgatggcaggcgcctgtagtcccagctactcgggaggctgaggcagaagaattgcgtgaacctggaaggtgaaggttgcagtgagttgagatcgaaacttacacagagcaagactccgtctaaaaaaattttactttttgccaaagtgatgagtgaaaatgaatacctaatcttgttttaatctcatttatggccatttttttcctgtgaagcatctctgcatctctttttcctttaccttttttcctatttgactatgtcttttccctataagcttataggagctttttgttattagaattttttttttttttttgagacacagtcttgctgtgtcacccaagctggagtgcagtggtgcgatcttggctcactgcaacccctgcctcctgggtgcaagcgattctcctgcttcagcctcctgagtagctggaattataggcgcgcaccaccacatctggctaatttttgtatttttagtagagacggggttttgccatgttggccaggctggtctcgaactcctgacctcaggtgatccacctgcctcagcctcccaaagtgctgggattataggcgtgagtcacacgtgcgtggcctttgctttaaattttctagagtaaaatgtgcagtacttatgaacatattacaattactactgtcagtacagtgtagcagagaaacatgcttcaaatgtatcctggagtgtctagcgcgactcagtgtctctgcacacgtgattccgtccattctcacttcttcacggagcctcttccttttaccctctggctctcagcacagtgtgtgtgtccccttcactgaactgccctgacagctggcactgtgctggtcttgtttatcctgcatgcacttggcctaacattaagtaactgttcagttaatatgtaatgaataatggaatgagctcctagatgcatcttcccagctaatttctgtaaaggcagaaacaatttggtgtttatgagaacttcaagaatatatgcagccaatcttgaaatcaaactgctcaaacagtctgacaatagccatggccactattctccatcatgctgttccatttaaaaaggacttacacacgtttctatctacttctcacactaaccttgtggagtaggtgggattatcctcattttcaccagtgagaaaacagaggctcatgaaagagaactaatctgctcaaggaaaatgactatacctgcagttctaaaccagggaaagagctgtttcggtgttggtttggaatcctcagtatgtggttaggtgttttcaggaccgcctccaaaaacttcattatatatatttactctattcattcatttaccaaatatttatcaaggacttactatgcaccagggtactgttctgtattctggggatatagcggaaaatgaaacagatacaagcccctgccttcatggagctcatattctaatgggaaaataaccagaaaccaattattgtagttaacatttgtgtattaactgtgtgctattctacatgctttacaggaaataacaaatttagccttcacatcaaccctacaaaataggttctgatgttatccccattttacagatggggaaattaaggcacaaagcagctaagtgacttaccctacacatcacatagctaatgaaatgcagagttgcaggattccaacccaggcagtctgatttcagatgataggcacttaactgttatactgtttcctctacaaaatgattttgaagaattattgaactataattaaactactttaaagggtattctctggactggtccaagatctaaccaacatgtgaataatttttatgtagaaaaagataaattttatgtccctctgccctggtaaaaattcagcagcactaggaactggttttctgccacatctttatggcaaggagcccactcagtgctgggagagggatggctacggtagcactgtgacttgatgactccgtcctctctcaccacacagttggaaatccctggctatccagaaaggagggaaatggcaactggggtatctgcccactgcaacctctaggctggctatttgtaggtgttttaaagtgggagaagtgacactaataactctgatcataactccaaaagcaatatgaagtggaaagaatgaggactctgaagttaggctgactggggtctgatacttatgttctggtactcgcaatgtgggcacctcctagctctctcatgaatatctgtgagaactgaacaaggtggtgtgagtaaagtgcctggcacagtgcaagatgtgcaaaatggactccaggtttccttctctgtggcctgtgtggtctgtactgcctttgaggggactcttcctgcagcccttgcctgcctgagcctgtgacgctcccttcatggtgctctcacacacagaagtcactataatgagcaatatgaactggtggtcctgccaatgaagatctgggggatttctgtaaagactccaggactcttgatgagacataagaagaggttccttattgaatgactgatatcagggaacaactcttaagaactgtgaaaccaaaattccagaagacacagcttgataatatgcaagacgactatcagtggtgaactccacttgacattttgagtagcggcaaccccattctggcattgcgtgtgtgcatgtgtgtgagctattaaccattctctccttaagcacatctgtattctggcccactcttagctggtaatattaagattttaaagggaaattttaaatttattgagggacattccagtgtccctaaatagctgtgcagcatttgactttgttcatacacactgcaccagccgctatgctaaagaacataaagactatctctgcatttaaacaacaaagagataatgtgagtttaatccccataatcaggttgttaacaaaaaatgtttaggctgaacattttacttaataccttacctttcgcaagtgtaacactcgcagaactcattattttctccaaagaacccatctccataataacaagaaatttcttctccaggttcaatgtctcttagagccttcacacatgctgtatctcgaccagttgacacaaactaaaataaaagtaactcagtaagaaactcacacctgaagcaaaaacaaaatacttgaagaaaatttttttaatgcttaccttacaattaggtctgcaatctgaaaaatgtccaaaagataaagtcaattaactgttgataagatctgaaacacgaacaattatagaaatctgaaataagctttccatataactttacaacttttgataggagtttaggtctcaagttcaactaaaggaatatacatttattttaataagtttgtggaaacatttctatttcaaattctcctttaaaggaagataaaggtttgactgaggttgacaaggccattctagcagttagcaggaatggccaacactagcgccaacaccttggaaacacagcttaccatggtttataaacgcagcaggacccagccagagttgagcacagtttttccttgtggagtacatgacactgaagtcgttttctccatgtctaagtagcatgttctcctcaatttctgaaagttcggcaatacaacccaccagtaattctattttgtcatttcgtttcctatttaaaatatgtgatgtgttaaaaattactagtaattaaatatagtaaggcttcttttaataaaataatcctgacaataaatatcagaaactgaaaaggcctagctgtctatactttagttagctcactgggatccccacctggctatcttctctcctaccctggagctccacagccttgtgccatggttacttgtgtacctatcttattcctgcaagagaatggaaactcaaccaggacagggactatgccacctatgtctctgaatgccctggtgtggtgttttgcaagcagaaaatacttgcggcaatgaattaaactttctgactgctggatgaagcaggcagggaccagtggcagtaagggttatgaggatccggaatcatggtgccactctttagagcacaccatctgctaggaatataatgcaagccaaattttcaatcttaaattttttagcagccacattgagaaagttaagtgaatataggtgaaattactttaacaatttattttattttattttatttgagacggaatctcgctctgttgcccaggctggagtgcagtggcgtgatctcagctcactgcaacctctgcctcctgagttcaagtgattctcctgcctcagcctaagtagctgggactacaggtgtgtgccaccacacctagctcattttttttttttgtatttttactagagatggagtttcaccgtgttggccaggatggtctcgatttcttgacgtcatgatccgcccacctcagcctcccaaagtgctgggattacagatgagccaccatgcccagccaacaatatattttaacccaatatccaaaatacgatttcagtaggtaatataagaactatgaatgggaataaaatttaatatgaaatctggtgtgtatagcacacttacagcgcttctcaattcagactagctacatttcaaggactcaagggctggtggctactgtaccggacggtacagctctaggactctagatctcaaacctacacacccatctgcaacacagggagccacataatccaactagcaggctcaatacatcctgaggtaaatgaagcacatttcatgtacacacactcaccccagaggcctggcaataaagttcttttacctatccattttcagatatctgaccccccaaatttttgtggtagaaatatcagagggtgggtacatgaggagctacatgtttttcctgggagataacatagggaacaggcatgataggaaagaagatacagtagtatattctctttcatctgtaacttttatcccttttagctgggctcaactctgacttaattttgagatagagtctcactctattgcccaggctggagtgcagtggcgcgatctcagctcactatagcctctgtctcctgggttcaagtgattctcctgcctcagccacccgagtagctaggactacaggtgtgtgctaccacgcccagctaatttttgtatttttagtagagatggggtttcaccatgttggccaggctggtcttgaactcctgacctcaagtgatctgcctgcctcggcctcccaaagtgttgggattataggcgtgagccaatgccccccaccaactctactatttttattgaagctggcatatatacatatatatatatctgtatgtatgtatttttaagcaactaatgctttagggaggtttccacccataaaactaggatcattaaaactttagccccaacctttcttctaggccagtagaagactgactgtggaagccaggttatctaatcacggtatccacaactcttcagcaatcatatcactgaacaggcatccagagtcaataaaggaaaatgaaaagcaatttggcctagagatgggatctggttcaactgagacttccgatttccccactctgactccagctgatgggccaaggcaacggcgatgcattggctacttcagggtaaactctggcttcattccttaccatgaatttctcagcacttcaacaataatttagaagagaactttaaattaaattaaaggcttatactagtagaatagttaccactcttttgttgcaactattttggctccattttgttctgatgagtatctattacatggcaatatttcaaatccactgtcagttgcaaacattcgcaaataaataaatacctaaaacaggaaaaaaaaaattgataatgactttaaatggtataccctgctagactttcttacaattataaaagcaaaccacccgcaatgatgaaaaaaatgtaagatctagcctgagcaacatagcgagaccctgtctctacgaaaaacattagccaagcatgatggcatgtacctttagtgccagctacgtgggaggctgagaggaagaatcacttgagcccaagagatggaagctgcagtgagccataatcaggccactgcactccagcctgggtgacagagcaagattctgcctctaaaaaaacaataaaataaacaaaaaaagtaagatcattaggtaacaaactttattgttactcaagagttttgaatgtcacaatttttctcattttgcaatatttgcattacagtaactagctgaacacctctaaacaaaaaattcaaaatcctcccatgagcatttcctttgagtgtcaggtcggtgttcaaaaagtttcagattttggagcatttcaaattttggggttaagggtactcactctgtatgagtacctaatggcttgtttcccttaaggctcataatgaatttcacctctatatgacaaagttttctctccttttttggttttagagacagggtcttgctctgtctcccagggctggagcgcagtggcatgatcatagctcagagcagcctctaactcttgggcacaagcaatgcttctggctctgcttcctgagtagccggaactacaaactacaaaggtacacactactatgcctagctaatttttttattcttatttttttagagatggagtcttgctatgttgcccaggctggtctcgaagtcctggcctcaagcaatactcccatcttagcccccacaaagtgctgggattacaagcatgagccactgagcctggcccagttttttctctggactgtcatccaaatgactgtatgtgttacaagatcttcagactgattagttttatgaaaaataaatttaaaatttcagtattaactaacatttagggttttaatttacttcactattcttatccaaataggttaacagcatcagtcttaataaacttacatgttctttgaataatttctcctgcattttattcttgttgagaaaatagtgccgtgcccattcgcctgaagtcaaacatttgaaggctttctccaagtgttcatctttcttaaaacgttcaattacttcctttagttcttcctgccttcctttaataggcctaaatctgaaagaaatcaaaagaatgaatgggttatctgccacaatccttgcgccactgatccatcttaacagatcttgagaaagagctaataccctaaaaacagccatggttatcagagcaaagatctaagagaagagaacaacaatcaatagtcttgattactactattcaagtaatactgatcacctggatacgcaagttctcttttttcaatctgttattttaatatttttatttcactgttatctcagtaacttctcttttttcaatctgttattttaattatttttatttcactgttatctcattaactgtgaggtgagcagacgattcaaacaaaagctgtctgattcagacttacactagtcgtcaactttgggagacacaaaatcaaagctctagaatacagcacacctaatttagagttagaatgacaagaatctttttaaaacatgcaaaatcaagctggaagagtgccaggcaatgaatttcagaagtatgatgatgtaaacaaaaccatgccatacacaaaaacattctttatgtacacagtcagaaaaaaccccaaactaagtattccaacaggcttcgaaacacaccttgatgttctaaccacccatgtcaaagtcatctttgatgactgcattcagagaacaaaacgagtacaagcagtgttaactctagtggtgaaattgctatactggtaatgtaggaaaactgatggggtagagttgttttttttttttttttttgagatggagtctcactctgtggcccaggctggagtgcagtggtgtgatcttggctcactgcaacctctgcctcccgggttcaagtgattctcttgcctcagcctcccatgtagctgggatgacaggcgtgcgccaccatgcccagctaatttttgtatttttagtagagaccatgttggccaggctggtcttgaactcctaacctcaagtggtctgcccaccttggcctcccaaagtgctgggattataggtgtgagccactgcgcctggcctgcaggggtagaattgaaaaggcttccattgtagaatcagccacactgatgtcttcagaatattatcccattaggtctgtatttatgcatgatgcagtcatggcccaagcaagacaaatttgtgaacccctcattctaaagctgtgttttcagtaaaacgtgtactataaagttactagcatcttaatttcaaattttcttttcatgtcaatttcataaagctaattctcccaaataaagtttttattttaaaaaaaagttttattttattttcataaagctaattctaaccggattatggcccggtatggtggctctcacctataatcccagcactttgggaggtcgaggcggatggatcacgaggtcaggagatcgagaccatcctggccaacctggtgaaaccccatctctaaaatgcaaaaaattagccaggcccacgtagtggtacacgcctgtagtcctaggtactcaggaggctgaggcaggggaattgcttgaactcgagagttgaagttggagtgagccaagatcgcgtcactgcacttcagcctggtgacagagcaagactctgtatcaaaaaaacaaaacaaaacgtccaacagaaaaaaggaatcaccgattgccattcaaataaaatacattaagaaaaaatattagtggttcaggagaaaaaaatctttatgtgtcttactctgacatttaaaattgtacatttcataaacctgaatatgctaaaattgaggtaagatctagcacaaactccagcaaaggaagcattcagcagaattttttttcctagagaagctatcatatatgtattcatagtatttcagtaagatttcaagccacagtatttcatcaaggattattaggtgctgtgttgtgtatacagtggcatatgaagtgctatggtgaaaaatacaagagaagacatggccactgttcttgaatggaaaatttaattgggactaaaagacatatatatgcatcaaacagttaagcaagtgatcaatatgcaaatgcatgttaatatgctaaaaactgcattgctatagcacctaaaagtatagaaattataactagggtgcaaaatgtacatgggaaaggtttaagaaaagcacattataagcaggtaagaatcaaaaggaaggaagaatgaggggaagtctaagcagaagatcttaatcaagctggattcaaagagttgaccagggtcagctaggtagcaataataaagtaaagtaccagaatcaggaagaggaaagacatgaggtcctgaacaggtataatactgtttactggacaggatcactggaagacttcaggtgtattaatgcatactgatactaccaggaacttactagctacacactctagtcattttttttttaattcagtaatcctgaattctcacaactattagctgaaccatctgaaagttcaaacatatcctagagataatactgaagaaatgaacagggccctattttccattttcaatcaattggtatacaagcctttacagacagataaatgcaagtcctttaaacaattcagaacgtcttactagtctgtcgacatatggtgtcagagaaccaccatgaaaataaagagctgtagaattgggaaagcatccaaatatccatactcaactacttgtagccatcacaattgattgtgtcaagataccatctccaagaaatccaatggaaaccattcttgctgcaatcctacactacatggttatttgcacatgaaggacagataagacaacaaagcagctctcagctaaggcatgacctgtcgagcaatatgaaatatgaaatatgaaatggtgggaaacagataacccgtgctttgtgtggcaatcagaaaagcaatagttcactttaagcaaatgcaataaattatccatgccgttaaatgacagggctacaaacgacagaaagggccaagctatctttacacgttcaatgtgaaagtgaccaatgggaacattatacaaaagtaagttatagacctggaatgaaacttggctatttttaataggctttatgtgtgttctatgctttctgaaacaagttcattcctatctaaaaatgccttcaggtaaccttggttttgtttactttttattcataatgccaaacaatttacatgctaaaaccaacacaaaatagtcaactcttgatttagtagtattctgcctaccttccctgtgttgacttctgtttctgctttcctgactttattgcctcaaacataaataaaacccctgaaactatcccttgctaccaatagcaagaacctctatttcactaaaaatataagttgctgtcccaaacctgttaaaacttactgtcacagttggctgctatgggcatgaaatgacagtaaggaaaagggggaagaaaatggttaagggtgcagacaggcaggagatgagacagttgttttcaataatcctacagaagtatgtaaaagtcagctggctgatagtccaaatcaaatcccattgtaacaaatactgtggaaaataaaagttaagactgttatacctattagggctggtgcaaatgcactgaaaaccttagggaaatttttttttttcctattattgaacagaaaaataccctctctccttaactataatcactctaaatctcccatacaaactgcataaaactatccttttactctgacacttaaaggccagataatttagaacagcccttttgttccacaaatgaggaaaataaggcccaacaaggctgagtagattgccaatgacttagggctaatgaatggaagacctgggatttaccctggcctttctggttcctgttatatcacctggctcaggagagccttcctcacattgtttcatggttagaagaggatttgacttgcgtttgccattgaacatcagcactgggcccagccagagacagctctagcttgtatactgacaatacagtggaagggatggacgcaaatgtgaattttaaaatttcgtatttgggtgggggggtgggtgacaagggaggcaagaaaaacagttatttggcatttccaaaccaatatgccccgtcctccctcccttaatagaaaatttgctactttaaatcaaccaaacatatctattttttctctttatacacttccaatcaatggctggtataagaaaaataaaaatgtcatttacaattgattattattaaaggggcaggaaaaaaacatatgaattcacactcccacacacctgttccccactctttccagagactcacttcccaggttttcttgctatttggtttttctgtctccccactgtggcagtgaagaaaagttgtagactgtattagctgtgctactgtgcccttcattagcatgcacaatcaagagctgactggaggggtggggaacaggaaggggaacagaaaaaagggagacagggaaggagagaggaagagagaaaaatgctcaaatatttaagatataaaataaaaccatgaggcaacatagtgaacacatttccccctctgaagaaagtttagctgcaaatccacagtttgtagacgctgagtgaggagtcgcagagcagctcttcagtccttcttgacctgaaaataaacgagaaccaaaaacatacctggctgagtcctgcaatcagtgctcagctaatcacatggagtgactcctgatcttttgaagaatgatttgtttctcttaaaatcaccctgttatgaagtacaagtggttttttaaaaaatacaactattatcaaactactttaaaaggtttgtaaaatgttctaaaactctaatttatgctgacacttcaaattacttaacataaaagaacattttaaaaggctagaatgggttagtcagtatctcattgtttttaacacacactacctacctcacagggttgttgtgagaaaaactgtcagattttgaaaaatgccttgagctcctcgaaggaaaggcgctatataaatgcaaaaacaaacaacaaaaataaaaagctatttgtataatctgtacttgtaatttctaaacagacttacaatattcgttgttgcaaaaatctttaaaactctgtgataatcaagaactttaagataccacaggtgggcgcggcaggatagaagccatgctgctgaaattctctgcttcccatagaacacaccttaccatgaagttagaagctttgaaaacattctttacggattctagtcaagcacttaattttaaaatgatatttaaagtgattcatattcatatccaatagtggatatgaataatcaaatacatataaaagtgaaataaaaattagatggttataacagtagaaaaatgagtaaggactgtacaggctgacattctgattagaaaaccaagaaaagttgaaaagagaaactcagtgccctgaagtgactcccctgatgtttaaatgctgtctcctgctcagctcactgctggcctgagtcgccttcgcgcctcaggatactgtgacatctcagggtcatgcagcctcaaaaagggggcattactgaaagcatcgatccctttcttaaaatatcccgctcccactccatttaaaaaccagaggtataaacaacaactctttttttcttgttaaaaagaaaactttaggtttcataattgacaaaagtcaattaagttcaaatttctcccaataaattgaaattagcattttgttcgtactatttctaagtattcatgctacaactcttgcttgttagtaaatgtaaggatatattaagattaaaacctgtgcactcaaaacatagccagttttgaaaattctccaatcattaaacatctactctttcttttttctcttttttttttttttggagatagagtctcactctgttgcccaggctggagtgcagtggtgtgatctaggctcactgcaacctctgcctcccaggttcaagttattcgcctgcctcaaactcttgagtagctgggattacgggcacgcaccaccatgcctggctcatttttgtatttttagtagagacggggtttcaccatgttggtcaggctggtgtcgaacacctgacctcgtgatccacccgcctcggcctcccaaagtgctggaattacaggcatgagccatcacgcccgggctaaacatctactgtttctaaacattcttcctgttggtagactgaaagaagtaaaaggaagggaaaagagtataaaaaagagaaactaaaaagtgacaaattacaggtgcataaacatatgaacaaagagcgcactatacaaggaacaggcagagagcttagaaaattaaaatccaagagcagtacatcttctggtcacttcttttgcaccccaaagagagagaagtccataaactaacaatttaagaagtatttattggctatttactaccttaattaagcattatcagttttccttattttctaaagtcacattctggtaaattcttgctcaaaagatgaagagctagaagggatagttttattttcaagtaaattcactaaggttaattgaaaacatatacctttcaccaagattattgtaaaggtcattaataaagtttctgttcccaaatatcagtgtacacaagagtgtaaaagcacacgtaaacggaacactctggtgggaagtaggcaggccgtcccctgcactgccacaccggcctgaagtgctggcattgctaggaacccaggctgctctaaccagggcaacagaatcgtctgtacttccacaggttattttaggaactgtataattaaatgttggactaaaaaatacttaaaaaatgatttcttctgcaagtttaaccagctttaattttagatgcttcaattctatggggaaaaatcttaggcactgggtgcattttaacttaggagtcctcagttaatgtcttgagttccaaaaatatttgtgtggtaatcctgaagtttacatttatgactacatagttttacgtgagccctaggaaactcctagtaaggtatttttatccacttagcacgtcacaatgaaactgagaggccagatgttttaggacctagctattccaagtgtagtctgggagcttgttagaaaggcacaatctcaggccccaccccaaagctactgaatcagagcctgcatttcaacaaactcccaggtgactctcatgtaaactaattataagaagcaatggtataggaggacttttacagaaaactggagtgcttccttttgttttttaatatagggtttcactctgtggcccaggctggagtgcagtggtatgaatacagctcattgcagcctcgagctcctgggctccagtgatcctcccaccttgccctcccaaagtgctgggattacaggcatgagccactgcagcagaaaactggagtatttactattgaagatgccagtaacaggcagccttctggaatacggcacggggattttagagtacatgaagttctgtcataagccactaaaactttcattgtaattttttttttttttttttgagactgagtttcgctcttgttgcccaggctggagtgcagtggcgcaatctcggctcaccacaacctctgcctcccaggttcaagcgattctcctgcctcggcctcctgagtagctgggagtacaggcatgtgccaccacgcctggctaaattttgtatttttagtagagacggggttttccatgttggtcaggctggtcttgaactcccgacctcaggtgatccgcccacctcagcctcccaaagtgctgggattacaggcgtgagccaccgcacctggcccattgtaattctgatgtaacgctgttttatatgcttccatatcttggtaataaggcataatcaatataactttcttgatgaccccaggtcaagattctgggcctttgtggtgacattctgaatgccactagactactgtgtcaaagagtgattcattcacacattcacatttcttaactcaaaaaaaaaaaaaacaaagaaaaacactgggggtgctacagggtgacaaatattatcagcatcttctaggaaaatgagcactggtctcatgttcaatgggcaaaaaaaaagaaaagaaaatggacttaaaataatgcaaattagttttttgtttttagccggagtcacgctctgttgcccaggctggagtgcagtggcgcgatcccagctcactgcaacttccacctcccaggttcgagggattctcctgcctcagccttccgagtagctgggactacaggcgcatgtggccaggcccagctaattttttgtatttttagtagagatggggtttcagcatgttggccaggctggtctcgaactcctgagctcaggtgatccacccacctcggcctcccaaagtgctgggattacaggcatgagctaccatgcccagtcctgtatcttttttttttttttgaggcagtctcactttgttacccaggctggagtgcagtgatgtgatcttggttcactgcaacctctgtctcccgggttcacgtgattctcctgcctcagcctcctgagtagccaggactacaggtgtgcaccaccacacccagctaatttttgtatttttagtagagatgggatttcatcatgttggccaggctggtctcgaactcctgacctctggtgatccacccagcttggcctcccaaagtgctgagattacaggcatgagccactgcgcccagcctggatcttaatcaatcagggcatccaatggcagtcatttggcagggaactgtttaaataatcccccaactccattccaatatttcacacttcattttagtaggtaaagatatatgacagaaaattttatggtcagacatggtggctcacgtctataatcccagcactttgggaggctgaggcaggtggatcacctgaggtcaggagtttcaagaccagcctggtcaacatggtgaaacctcatctacactaaaaatacaaaaattagctgggtgcagtggtgcacgcctgtaatcccagctacttgggaaactgaggcagaagaatcacttgaacccagaaggtggaggttgcagtgagctgagatcatgccactgcactccagtctgggcgacagagtgagactccatctaaaaaagaaaagaaaaaaaaatttatgaaaaaaacaaaagcatatttttacctgaattacttcttttggatttagactgtaattgataagtgaggcatatagtatcttaattctagcaagggataaaattaaaaggggggaaacaggacacaagactttcctctaattacctgtactcaccaattcctacctctcccaactactgatcagtgaccacctacctgggtatcaagttcccccagggttgccactaaaatcagaactatataaccccagtccgggtgtgatggagatgaaagtgatgggccagaactagctctatcttctaaatccctgctgttatgcttttccaccaggctaaaaaaccctttgccatagaggttaagagacaaagcaaagttgcaaagctctgacctgtttggtggcagatacatttgtgaaatgatctaatggtcttttttgagggagaaatggtatttaagagaattaaagagagacctcagctgttaaaagatgacagatttcaagattaatgtaataatgttttttatatacagcatttggtactcaaaacacttacacatccactttcttacctgcatactgaatataaacatgtctttaaaactattcgctcttaaataattagctgaatcccaaagattaaacatgatgacaaaattccccatctatacagagacaacgtgtaagagaaaagtctataataaaatcatgaaaaaaagggatgtaccctactttaggttggaaataatcatacactttcaaggtgttacaggatgcttgtcagatttttcttttcgctaagataattgtcatcacctttttttttttgagatggagtttcgctcttgttgcccagactggagtgcaatggcacgatctcggctcactgcaacctccgcctcccgggttcaagtgattctcctgcctcagcctcccaagtagctgggattacaggcatgtgccacctgcctggctaattttttttgtacttttagtagagacagggtttcaccatgttggtcaggctggtctcaaactcctgacctcaggtgatccacccaccttggcctcccaaagtgtggggattacaggcgtgagccaccatgcctggcatcatcaacttttaaaatagaacatgaggatgctcctccagctttatacgttaatagaaatgttctgaggtaaaataagaacacagagttagaactgacaagattcctggagtcttttctctgcttctcttggctcacagacagaaaacccttccactgcaaagaactttcctttaatgtcattttaaattttgagcaaaagtaaaattagccatctatgttcttgaattcaacataatcatctgttccattcaggataaagactgaaaattacctagtattcattttgtgtgtttgaaaacctaaatagggatcaagaaccaaactggttgctaggtcatcattttcacagagttccttggcggacattccagaggatggtacatagcgactctgtccttcaaatcccgagttaccattacctgtgaaaagcaaaagcaagaaaaattactcaaattgaaaactacttaaatctgccttaaaatctttagcggcattgcccattcaagctggtaataaagaactgaaaaatcaatcattttagtaattaagaatttaataacctttgcataagacagaaaaccaaatgcagtaaactatctccattactgagagtattatcgttagcaggtagtaatagcaggttcccaagaatggggtctgggtagtcgtgagaatttggttcaaatgcttgactctcccccacccccttctctccaaggaacactgagaaacgggacgggagcatgttcactattttaacaagacaatacacagggccattacagataggactcggctgaaaaggaaagaggaacacaagatagtttctgcaagaagcgccagaactccagatctcaagtatcaaaaggaatctcatgaagttcagcttcctgctttagggcaggtgaatgattattatccccactttgcaggcaactgaggcccagacaaaaagaaacttgcccacaattccagagctgggcagtagaagtggggaaagaagtggagagagaatgacagacctatttctactgacctctgtttgaagcaattatgaacgaatggataaaaatacagactgaaatatataactgaaataactgggtttaactgtggaagaaaagcaatgtaaagaaggaaatgaaggccaagtttgtaagaagtttcatcagagctgattaagtttgatgtatatgccactgacagtccttccatggaatcagcacatcatttatggaggacaacagcaatgtaactttcaggctctcaaaaccaaaatggggaagaatgaaacacagagtaaagtttaaccttttcatccactctttcacagaacaaatacttaaatgtaagttcctgccaagggtagacatatgattttgcaatcaaattagttgcatgtaggtatgtgaaaagctatcaacattgttaaatttttggtaacagcataatagctttattgaaatacaattcacatacgacacaactcactttttttttttttgaagacagggtcttgctttgccacccagcctggagtgcagtggcatgatcacagctcaccgcagcctcgaattcctgggctcaaggaatcatcctgcctcagcctccctagtagctgggaccacaggcatgcatcatcaaacctggttaatttttgtatttttttgtaaaagtggggtctcgccatattgtccaggctggtcttgaactcctgagctcaagccatcctcctgcctcagcctcccaaactgctgggattacaggcgtgagccaccacgcccagtcttctttttttcacgcaggcatttacaagtataaatttccctctaaaccaccgctttggctgcatcctgtaagttttagtatgttttatctttcttttaattcacttcaaaatgttttctgatttcctttttgatttcttctttgacccactgattatttagaagtgtgttatttcatttctatgtatttgtgaaattcccaaatttccttgttaatttctaattttcctccattggggtcacagaacataccttttatgatttcaatcctttgaagtttatggaagcttgttatacggtctagcatatgttctatcctggaatgctgcacttgcacttgagatgaatgcgtattctgatgaggttctatagatgtctgttaggcctcattggtttatagtcttaagctgttctatccattattaaaagtggcgtatcaaagtctccaaattattgctgaattgttgatttttcccttcaattttgtcagtttttctttcctgtatcttaaggctctgctgctgggaaagtcactgattgtatctgagatggggcactgctctgtgctctcccatttctcattgctggctctctttctgcaccattctggcccaataacattcaatgtaaggctatgtcatcttcacacactgggttttcccaacctagccctctatatttatctatgcttggtaaagtgtaaccaaagtaatggccattttcctttttcttttttttttttttttgagatggagtctcgctctgtcgcccaggctggagtgcagtgacgcaatctcggctcactgcaagctctgcctcccgggttcacaccattctcccgcctcagcctcacgagtagttgggactacaggcacctgccaccacgcccagctgattttttgtatttttagtagaggcggggtttgaccgtattagccaggatggtctcgatctcctgacctcatgatccacccacctcagcctcccaaagtgctgggattacaggcgtgagccaccacgcccggcccgtaatggccatttctaaactctttttttttttctttaaacaagagtctcatttttttttgcccatgctggagtgcagtggtgtgatctcggctcactgcaacctctaactcctgggctcaagtgatctttccaaccacagcctctcaaagtagttggaaccatagacatgcaacaccatgattggctaatttttttgtagacacggtagtttttgtagacacagggtttcaccatgttgcccaggctggtctcaaactcctggacttaagcagatccattcgccttggactcccaaagtgccgggactacaggtgtgagctaccacgcccagacgcattttctaaattcttgtgtatctataataattcaactaattaaaactgttttgcactatgatacacaaaaggaggccaacagtgatttcctaaaaaacttaagatatgcctagtttgctgaccagaatgaatacacactgatgtgatcactatatttctcaattcttcacgttcacactagctgctaaggagtgaggcaggatgagggtacatgctgccagcagcctcaggagtgagtggtgtccatgcagaggaccactcattcagtcttgcctcttcctactcttgtcccaagcaggaattctgtctggttttctatagcaacagtgacctgatctgaaatggaaaggttaagggtagcctgggcccaatgaatcgcataaaccctaaaaggtaagaaggaaatctatcagaacttgtacaatctgaaactacagaaaatcccaggctaatccaaatccctggaaacaggccaatgccaatctgaattaaggatattcaaaggtggctagattcacgttagaaaaagaagaaaagctgtcctctttaacatgacatacgtttggacatatagctgcctagttaggtatacacttgtcctcagtcattttactacttttagaggaactatgaaatacgcaccaaatctacaacttcctgaactctcaaaaagcagcctctttcctatcaagaggtatagaggaaataaagtaacttatcagcagtgtttcactgtcaggatgaacaactgtctaccctgtataaatagaataaattgctatgatttgtgaggctgccctaaagcagtcagttctatctatcctcattctacttatgtaaattacagttggcgtcattattcatattattccatgaaacatttgtggaaattagcaaagaagtacatacctatacttacatctattaaaaaaatacaggttaacctgtaagaagttcaattaaaattttaaaaatttagtaagacatatcaaccattcaggtaaattctacaaaatataaagtaacagacagaaaagcatgattaaaataattatatgaagcattaaacttgagttttatatagtttgatgagaataaaaattgacacaactttgagagtaaaaagactatattgttaattatgaaaatgcaaaaaattatttaagacaaaagaaaacagaatacacattacaaactggaaagaattactaccccatatcacaatcagaacattgaaggtttaagtgtgtacatacatctgttcgacctcctctcgactgcatttttgccagccttcagggtgtccttccccgtgtgctgtaattttgattgattctgctgatggtcattagacaacttgcctccatttctcctgccattcaccaccatgttcttggattctcccaaccacttcatacccacagacagcctgacccaggtgcatttagtcactctcttcaaatagcttagagaatactttcaatgttctctcctaacagaaacaaaatatgaaaaacaaaacaaaatggggagataaatacatgaaagatcatgctaaacagacccttgagaaagatatataatattaaaaggacagtcattcacagtataatgatgttttggtcaatgacagaccacataaacaacggtggttccataagattataacagagctggacatacacttcataaaattcgtattgcctagtatttactatattatactttttactgttattttagagtatattccttctacttttttttaagttaactataaaacagccccaggcaggttattcaagagatattccagaggaaggcactgttatcacaggagatgacagctccatgcatgctactgcccctgaagacgctccagtgggacaagatgcagagggagaagacagtgatatggataatcccgaccctgtgtgggctgaagctaatgtttgtgacctgtgtctcagtttttaataaaaaagttaaaaaaataaaagtaggaaaaggttatagaataaagatattttaaaaagaatatagctgagcacagtggctcatgcctgtaatcccagcactttggggggccatggcaggcggactgcttgagcccagaagttgagaccagcctgggcaacatggcaagaccctgcctctacagaaaataaaaaagtgagccaggcatagtggcatgagcctgtggttccagctacttgagaggctgagatgggaggtcaagcctgcagtgaagctatgattgcaacactgtactccagcctgggtgacagagcaaccctgtcttccaaaaaagaaaagaaaataataatatatttttgtgtctttttgtctgtgttttgagacagtctcactctatggcccaggctggagtgcagtggtgtgattatggctcactgcaacctcaaattccagggctcaaccaatcctcccactcagcctcccaagtagctgggactagaggcaggagccaccacatccagttaattttaaaactttgtgtgtgtgtgtgtgtgtgtgtgtgtgtgtgtgtgtgtgtgtgtagagacgaggtctcactatgttgcccagactggtctcaaactcctggcctcaagcaatccctccaccttggcctccaaaagtgctgggattacaggcatgagccactgtgcctggctaagaaagaatatacattcatttatttgagacagggccttgctctgtcgccccggctagagtgcagtggtgccatctcttctcattgcaacctccacctcccaggttcaaatgattctcctgcctcagtctcctgagtaggtgggattacaggcgtgcaccaccacacccagctaatttttgtatttttagtagagacagggttttaccatgttggctaggctggtctcgaactcccaacctcaagtgatccacctgccttggcctccgaaagtgctgggattataggcgtgagccactgtatgtggccagaatgtatttttgtatagctatatgtgtttgtattttaagccaagtattaccataaaagagtcaaaaagtttttagaaaaaaaaactttataaagtaaaacagttacaagctaaggttaattattgaagaaacatttcaaaataaatttagcgtagcctaagtgtacggtgttaataaagtctacaatagtatacatgtactaggtctacgcaattactcaccactcactcactgactcatccagagcaacttcaaatcctgcaagttccattcatgggaagtgcccttcacaggtgtaccattttaaaatcttttattctgtatttttactgtatctttatgtttatatatgtttagataacaaataatattgtgttaccagtgactacagtagtcagtacagtaacaagctgtacaggttagtggcctaggagcaatggcccaggtgtgtagtaggctagactacctaggtttgtgtaagtacactctatgacaactgcatgaaaacaaaaccacctaacctcacatttctagaatgtgtccgagacacactctatgagtgcactctatgatatctgcacgataacaaaatcacctaaactcacatttctcagaatgtgtggtatccctgtcattaagcaatgcatgactatactttaataactgatgtctccactctttaaagacaatcttggctctccccaatcatatgatgcctgctcaggaatacagtgcccccagactggccagaatgtaaactacagaaggcagggactcattctgacttgttccttgcttgtgtttagaacagtactgacaaacagcaggtgctcaacaaatatttctctcagtaaacagtaagaaccatctttgctccttgttatactgatatctagtagagctttctcatctatctgctcaaactacatgttttggtaatgctctgaactgggtgagtaaactacaaggaagttatttatctctttgttccaaggcaagcttaggaaaaggcatctatactaagctttgtccatcacagtaagagactcctaactgttgtgctggctactcatcaccacaaacaaaatttagcagagggacaagagtaaggaaagtaaaggacttcatatctctttgttgttgttagtttcaattcactgttctagatatttaagaaaccaatattcagatatcaaagtagtgcccatctggaaatgtctaccttatcattccttcacaatggcaacaaaactgagaagctactgtattcggtaatgtaaatgtatctcttactatctgaatttgggaaccgattgatctgaatagtgggggatgcttgtaatttataatgacctttggaaatgaggatattatacatcacactcactactaatggaatgagaaaaaggatgtccatgataccacctcattatcgaattatgcattagtacaagtcagactaaaaaggccctacgataaagggcaaaaatacagaacttcagagccaaagatgccttaagatcatcagtgcaactccttcaatttgcaaatgaaactgaggccacatgcctaaaaccacatgatccacctgcagcagtctcacgagtagaacccagcactgctgcccaacaaattctcaactacaccagacgcaggtcaatttcctttccacaaacacatagaaaagtacaaatgataaattacttcgaagtattcacaaaaatacatgcctggacatacctttaatgatactcaacacaaacacaaaacatgaatttttacttgatctcaggtctctttcatgttacaggagtatctgtgtgagttcactggagggtaagatgtgcatgtgagcagtatgcttaggggaatggcaaaaaaaaaaaatctgatcaatgctaaagacaactttacaattgttttctaacatgaattttttttctggttcccttactatttaaattcgattatagtatttaacttttaacgtgccttttgatttttctcataggtttcactaaacagtcttctatctattctacatcagttataagctaaggatttttcaattattaaattttaccaaatttaacattaaaacctctcattaatgatcatatatcttacacttaggagaaaaggcatagaattgaacagcagtatacttttttttttttttttaagagacagggtcttgctctgtcacccaggttggagtgcagtggtgtgatgatggctcactgtggcctcaaagtcctaggctcaagcaatcctccacctcagcctcccaaagtgttaggattaccagcatgagccaccacactcagtaagagcagtgtacttttgaggtataaagtacaaagaaagcttgagaaaaagagcaatgggtggtccattgggagccttggatcttggatccccagcagttttgcctatggactctaaaatggacttcatttaaagaaacccatggaacagtaatagataaaaacataaaacaatatgaattgtggcattcaaatcctagcacttcgggagagcatcaagtaccaagtttttttttttttttttttgagacagagtatcgctccctcacccaggctggagtgcagtgtccacgatcttggctcactgcaacctccacctcccaggttcaagctattctcatgcctcagcctcctaagtagctggaattacaggtgtgcaccaccatgcccgcctaatttttgtattttttagtagagacagagtttcaccatgttggccaggctagtcttgaactcctggccacaagcgatcctcccacctcggcctcccaaagtgctacgattacaggcatgagccattgtgcccggccaagtgttcaaaaattatagcctactatcacaatgcattgaagatttgaatttcaataacctcgtcaagacttagatctttaaaagcttcaaggttcatctgcattaaagctctccatcattgagccatctcacaaaagtaaaagcttaaagggactaaaatccgtgactacattccattttatatcccttcctcagttttcttcaatttccttgacccctagggtctttcatattacttatgttcctttaagacaagagccaaagaaacagcactttctgaaaaacagatgttctgtggctataagctttcattggtacagatgcataaacttggcatgataaatttagaattaggttttttgttgtatcctataaaaagctgcattaacaacaagcaaatgggccaggtggtggcttatgcctataatcctagccctctgggagaaaaaggcaagaggactgcttgaggccaggagttcgagaccagcctgggcaacacggcaagacctcattgctactaaaaataaaaattaaaaaattagccaaggatggtggtatgcacctgtagttacactcaggaggctgaagtgggaggatggctgcagcccaggaaattgcggacacagtgagccatgaccatgccattacactgcagcctgggtgacagagtgaaaaaaaagaaaatgatgaagtggtaaatttatataaatgtattttatatttcaagttagattatactctcagaagctatgtggtttacagaaaatagccctctcctatcccacctctgtctcttactaggcagttggtaaccaacaaagtcacttaacctctctgaaccttaacttccattatccagaaagtgaagctgatcatattttccccatccacctcacagggctgttgtgaggatcacatgaaataatgtacctaaaaaagttgtttctataaaaggtacaacacagatagatccagggtcctgttacatagttgcaagtcacactcttatctccagggcctgggaaggtaggtgatttaagcacacagaaagcacctaccatgtccagggcacatacatggtaacaagattatgttattttcctctgaatacacagaatactaccatgggctaattctaaggagcaagactgtaactttccctaaaattatagctcagcattcatagtgctctagggcaattatgggttgtaacatattaatggtttgcaacattttttttactatgttgtgaccagtaattttttttaaatgaaagaacacagagcagaatatttcacaatgcatcccacatagtaagttttgttttagttatatatgtgtaaatgtgtgtatacttggtcattaaataaaatgaatttttggccaggtgtggtggctcatgcctgtaatcccaacactttgggaggcccaggtgggcagatcacttgaatccaggagtttgagaccagcctcgccaacatggtgaaaccccgtctctaccaaaaatacaaaaattagctaggtgtggtggtatgcgcctgtaatcccagctactcaggaggctgaagcaggaggatcacttgagcccaggagatggagggtgaagtgagccaagactgcaccactggactccagcctgagtgacagagcaagaccctgtctaaaataaaataaaataaaatgcatttttttcctgggggtgtggggaagggcaatgcaccatgcctttctcctctgtctgcctggaatgttataacaccatctctttgcctaattccttaagtcccagttcagtgttcacatcctctaggaagtgttccttgacattcactgccaaatctagttatatacttatgctataaaacttaagtgaaagcccttatgtgactatattgtttaagtgtctgcttccttaattgagagttcctaaggttgagaatctatttttcttatctctggcccttgtgtatctagtatagcacacagtacatcctagaggcactcaactgatgaaataaataggttgtattctaaactgcatcatagaaactatatttctgcattaaaaaaaactgtaaattaaagatacttcctgacctcttcaaatcctctcctttctcaaaatgtccatggtgtgtaagggggtgagagaagctcctgcacagacagaaacaaggcaggaatcacagctgctaccaccactaacttccctactgcttgccattatactttctggtttactccctagtccttgaccctccagagaaaaagaaccaggaccaggaaaagtgcttttggtcctttaggaaatcatctgtagaatgcctgtgtttaacacacaacttatggataatcatggaacaatgtacttttaggcttctcaggagtcctaatatacctcaaaaataagacataaagcataattatatgaaatagaaataaaatatatggaatagaaaggttatccatggagagtctttttttttttctttttttgagacggagtctcgcactgtccccaagttagagtgcagtggcccaaactcggctcactacaacctctgcttcctgggttcaagcgattctcctgagtcagcctcccgagtagctaggactacaggtgcgcaccaccacacctggctaatttttttttgctattttagtagacacggggtttcaccatgttggccaggatagtctcgatctcctgacctcatgatctgcctgtctcggcctcccaaagtgctggaattacaggcgtgagccaccacgcccggccatggaaagtctttaagtcccaaccaagatgtctacttgagagaaagcagaaaatttggggatgaggcccagcaatctgtgttgtagtaagacctccaggtgatgcaagctccagtgtaagagcaatcgctctaatttacttattcattttatcatgttagggcaaagaatagatacaaaattttaagaaaaattatggaataaaaaattaaggaaattataatatcaaccaaacatttttctgagaattaggaaaattcaccaacaaatcactttagtaatagcaaactttggttcaattcatggaacacagactgagatccactctaatgtgcacataatttaaattaaatgtgggttaatgatccaaactggaaaaaatctgtgccctcagatctcatttatattgtgatcaactgatattatttgaactcaaggtaatttaatctaacaggtacttctgtcaatcacagaacatggctaaatttcactagtatgaatgcactgcacatgtctggatgtagcctagcagagagagattctccacaggtccatatgataaaagctatcaaaagatctttcttaaactgataaatgaaacatttgtaaaaacaattctaatgaagctatcaataatttgggggctatttaaaaaaattttcagctcaaaatgaatatatattgtactaatgatcaggtcatcatttgttctgccctcctaagtgtggaatctgttcttgctggcatgatctttcctctaagaccacacgtttacacattaaaggtagcgatgggattttaaaaagctaacacaagtcgatactgtagtagagtatagacaaataggggttgaaaacatcccagcactttgggaggccaaggcgggcagatcacctgaggtcaggagttcgagaccagcctggacaacaaggtgaaaccccatccctgctaaaaatacaaaaattagccaggcgtggtgtcacatgcctgtaatcccagctacttgggaggctgaggcaggagaatagcttcaacccaggaggcagaggttgcactgacccaagattgtgccactgccctccatccacagtgggggagacagcaagactgtgagaaggaaagaagagaaaagaagaggaaagaagatgaaggaaaggaaaggaaaaaagacaagacaagacaagacaagacaagacaagacaagacaagacaagacagggcggctagcaaagcctaaatgcttcatagctaccacagaggtgccccctcccaacaaacacacaagggtgcagactcccatgggacatagctggctcacgtggaaatgtccccatggtcacggtttggctgacacactctgagctaattagccactgactacatttagaagtaaaaattgcctcaattttgtcccaaattgttaggaaaaacatttcaagaaagtactgactgcttcttttttttttgagacggagtctcgctctgttgcccaggctggagtgcagtggcacgatcttggctcactgcaacctccgcttcccgggttcaagccattctcctgcctcaacctcctgagtagctggaactgcagatgcacgccatcacacccggctgattttttgtatttctagtaaagatggggtttcaccgtgttagccaggctggtctcaatctcctgaccttgtgatctgcccgccttggcctcccatagtgctgggattacaggcgtgagccaccacgcccggccattactgaccacttcttaaatggtgtattagcttggtgcaaaagtaataaagtaattgcgttgttttttttttagttacaaatcctgttctgatttcccaatataaaaatgtcaggaaaattagacatccactatattccagacactgttgcaggcactgagaatacagcatggaacaaaataaggcttctgccctcatctgtgcttatattctaatggaaaaaagcactaggaaataataaattaacgaatgaatgtcggcaccttttggggggaataagccatttatggtggcagggagtgtttcaggtggagaaggagggtgatagtggctgttttctaagacagcaagggatgtgaagggacagccaggcatcaggcaagaagcatgcagtagacaaagggaagggcaaacacaaggcccagaggctggcgtggctggggcaaatatggaggaagagtgggaggatgaggtcagagaggctgccacagggaagaagggcttcaaagccactgctgagacttgggcctttactcccagtgagagggaaagcagaggagtgacacgatccaacccacagttttaaaggaccatgctggcagcttgctacatggtactttaaaaaagcagttctaatgaagctactaataatttctaggacaagagaatgcagggagacgttattagtagtagtagtctatttactaactgactactgctagccagaggagaactagtggctgcagcagcagaggtggcaagaagtggttggcttcgagatcttttctgaaggttccgctgatagtcgggaactgctgacagattgaatgcaggtgtaggagaaagaggactcaaaaatacctgcaaatgaagaatggaattaatatttagggatgtgacaaagactataggaagattggcttccgcaaggactgcggtgtgggaatttggttttggtcattttttcttcctttttgggggtcttttttggttttagtcacttttgagatgcccactacagatccaactggagttggcagctggataccagggtctggagtccagctccaagctgaagataaaaatctggtatttttatcttcaaataaaatcaaagtattaatggcatttcaagccatggaatcagatgaaatctaggactcagtgcagatcaatgaagtccaaggactgggtgtcgggggcactttaacatgtataggtcaagaggaggagaagcagcacaggatcacaaaaggagcaacaagtgagaagcagagccaggcatgacagggaccactctgtggagggagttaccaactcaggcaaggactataggtgcccagtaagcaaatacttttattttatgagtctaaactcgtggaaaggatgggctattgctgatctgtgagccttgctcagaaacaacagagaacttctaaatggacacaatgtcttaaaacacgcacttgtgaggaagacggggctttgctttaagaaacagatggcagagggcaatatcaggaacgagagagagagagactgactcgcaggccagaaaagacaaatgtaagttaaaattatggagtgggaggtgatgggaataggttagttaatttgagaaggcaagccttcagagcgcttataggatctgtgttaaaaaaatttttttaaactaatagattggttaaatctctggatgggagtaatacagatgatctgagtaggaaaacgaagtggaattcctgaggactactgtgcaaggctttgtgccttctactttcgtgagtattcacagaaatgatgcaatcaggctctgagaaaatggaattgggattctgctccaagatgggcagcatcacttccccaagggatttacccagcactgaaatcaacaggaagagtcaccttatgtggtttcactggatcaacacatgggaaaagaagcacttactacagattctggtaccaaacataaataaggaggtggggggtgaggggacaatttatgatcaagataaaacatactggaaaactgctaaaataagaaatgtatttaaaggggaaaagatttcaagaatgatttccagttgtatttaaagcggaaactcctaatcataacacgatgccactaaggtgagaagcgcgacacccaccaccaccagcaccaccacaatgcattccaaatcaccagtgctaccgttgctggggggaaggataactttcaaaagtattttttccccaaacgtttacagtgaacctatttacttataatcagaaaaaaactgaaaaccttaatactttaacacatttcaaaagaaagcagcattgattcatagaaaatgggctacgttcacataaccatgcctgttctatgccagtgatggcccctcaacaaatgtcaatgcccttctctttccaggctctttatgagattataaattgttgagtgacttttgagaaattgtgtccaatttgagaactctgattccaatccatttttacttaaacacaggcattttttgcttaatatcctaaaaacaaactaagattaaaaaaaaaatctgtcaaaaaagttaaaacactgattctgaatgactagaaagaatgttaacgtaattcctgtgacattaccgagaaccctctagccagttgacatgctgaacttgtctgcaaacagtttatcttagagaaattatccagtggcagggaaacaatccccaagtggttgaaaaagaaaagtcaatacacatttttaaaaagtaggttctggctgggtgtggtggctcacgcctgtaatcccaacacttagggaggccgaagcaggtggattccttgagcccaggagttcaagaccagcctgggcaacatggtcagaccccagtctctaccaaaaaaaaaaaaaaaaaaaaattagtcgggtgtggtggtgcgtgcttgtagtcccaggtactcaggaggctgaggtgggaggatggcttgagtccaggagattgcaccactgcactctagcccaggtgatagagcaagactctgtctcaaagaaataataaaaagcaggttctagcctgttagaggactttcataaatctttatttagaaaggcaaagaaaacatttttcaagtgatttagttataatttggtaagaaaacaatccagtacaccactggttaacagtgagtgagattacaatggagaatgacatcacaagcaatatttacctgctacatgttcaacttttcaaaataaacatctgtgacttttgtaacaaaatattaaagatacttacacaaaggaaagggaaacagcttggcagcttcccaccacagggcctttgcacttggggtgccgccacactgctcctcagtccctgcccaaccccacttctccagctatatagatttccttgttatacattttaacccttaacgtttctcagcatggtgcttattacaaccatactcactactctgtgtaattatctggtaacacctgccttccctactagctaagacacactttttttttttttttttttttgagacaaactctcactctgttgcccaggctggagtgcagtggctcaatctcagctcactgcaacccctgcctcccgggttcaagcgattctcctgcctcagcctcctgagtagctgggattacaggcgcgcaccactatgcccggctaatttttgtatttttagtagacacggggtttcaccatgttggttgggctggtcttgaactcttgacctcgtgatttgcccacctcggcctcccaaagtactgggattacaggcgtaagccactgcacctggctttatttccatgttttggccgaataatcctgctgtgaacgtgggtgtacaaaatacctgtttgagtacccgctttaattcttttgacgatatacccagaagtagaattgccgggtcatatggtaattctatgctaaactttttctttttagatggagtcttgctctgtcacccaggctgtagtgcagtggcacgatctcagctcactgcaacctccgcctcctgggttccagggattctcctgcctcagcctcctgagtagctgggattacaggtgtgtgccatcacacccagctaatttttgtatttttaggagagacgaggtttcaccatgttggtcaggctggtctcgaactcctgacctcgtgatctgcctgcctcggcctcccaaagcgctgggattacaggcgtgaggcaccgcacccggccccatacactttcatatcattagaatccagcacaagaccagacataggtccattcatatcaccttccctttctattctcaaaccaactgctacacataagcagaatcggtttttagttttctcctaaatgtgaaatcacaaaaggacttgacatcaaagaattccaaatcggtctttatcaatggctattccaaagccgtctgcaatcaatattgcaataactaaggctccacggaatcctatggtatcaatcccagcgatgaggccaataaaagaagccctgcaaagctatcagaagcatttgtgaccaatattccatcataacaccattaacactgcttgacagggcaatttctcagttgctaatttgttagaaaactaccacgaattcacgttcatacctgtaaccttaaaacttgctcctataaacattgttgtctcacctgagaagctaggtgacttgtcagagtagttcaacggggtgttagtattatgaaaagagaaaggcctcagggttttcatttccctgaattcacaattatgcttctacctaaggcagagcctttactttaaaattagagctgtcacgctaattcaaatggtaatcaggtatctagaaccatcaactccatagcaaagaatacgtctctatactcctaaaataattacaaatgtccatgatattatcattcctactttccttctctagctttcatagggtcaagcttggatgcattttgcttcacccaattcaacagctttcccaagtaccctcaggtggtaatgccctcactcaggccaccaagagaatagcgtctgaagctgagcagtttacctaccaccaaggtagaatgcttcacccactgccctttcagaataaaacgatggccacagacaccatcactaagttttgaaaaagactaaacttgttgagctaacagctctaaagcagactgtagtatggtggaaaacggcccccaaagacatcggctcctaatctctggagcctgtgaatgctaccttataaggaaaatggtctttgaagatgttataaaaaattttgagataaaagagattatcctagattatctgggtaagccttaaatgccactcaaatgactttataagaggcagagggagatttgacacctcacaaagtacagaaggtgaagcagactggagtgatgtggccacaggtgagggaatgctgcagcccaccagaggctggaagaagcaaagagcagcttccctccacagccctgccaacgccttgactttggcccagtgaaactgatgttgaacttctggcctcgaaaaccgtgagagaataaatttccggtttttttttttttttttttttttttgacacagagtctcacatgttgcctaggctggaggcagtggtgcgatctcagctcactgtaacctccacctcccagattccagcaatttctcctgcctcagcctcctgagtagctgggattataggcacctgctgccacgccaggctaatttttgtatttttagtagagatggggtttcgccatgttggccaggatggtctcgaactcttgacctcaagtgatccgcccaccttggcctcccaaagtgctgggattacaggtgtgagccaccgtgcccagcccatttctgttgttttaagccgctaagtttatggaatttgttacagtgaccacataacagagattatgaaaaactaaaccaaagtagaaacgctttacagttaccacactccaaaaatacataaaattccaacatgtcacaggaaaaaagattttaaacaacttttaaaacagtgtatttaaaacaagttttaaaagactgggcaacaaagtgagaccctcatctctaccaaaaaaaaaaacaaaaaaaacaagtagccagttgtgctgctgcgcaacttcagtccctgctactcaggaggctgaggctgaaggatcatgggagtccaggaggtagaggctgcagtgagctatgatcatgccactgcactccagcctgggtgacagagtgagacctcacctttaaaaacataaataaataaaaagtttaaatcatacactatccttcaactgaaggtataaaatgcagctactgagttatatagattttgaaaatagagccagcctcttaattacacctctgattactcacacacttgctaggccagataaccatgatcttcctgaatagcattgtaattgaacatttttctatttatattaaaacttacaataaaaactgaaactattagaatttctcattgagcaaaacattttaaggagcaaactatccactactggtaagtttatgatcagacattcgcaattctttttttttttttttcagacggagtctcactctgtccaccaggctggagtgcagtggcatgatctcagctcactgcaagctccacctcccgggttcaagccattctcctgcctcagcctcctgagtacctgggactacagacacccgccaccacaattagctaactttttgtatttttagtacagacagggtttcaccgtgttaggcaggatggtctcaatctcctgacctcgagatccacccacctcggcctcccaaagtgctgggattacaggcgtgagccaccgcgcccggccagacgttcgcaattcttagacttacttatttggctactgatctacagccagacatgtaagaaactcctaattgccttatcacagaaaatactgcttcattcttaaatatcacattcaatacgtatttacgacgagggatgtcatgtaagaaagacttcatgtcttcatctcagtagttattttaaaacaaaggttttcactgatggggttgttgagggaaagtcctcaaaaaaacttccagaagaaaacaaaaaatgcctgcttcccccatctctccacatttgatccatctgcttacctagcagtgcctagaaataaaatcaaggatgctttctttgttactgttttctctaggactcaaacagccattcacggttctagaaacagatgccacctagtgtcaaatgactgtaagtacagcctttacagcccacagtttctgtcagaagttacaagaagtacatcaaagatttttactgggcaaggacaagtgtgaggaaaagcttccaaaaggtggttcttgggctggacgttagaggccactttgagtttgccagctggtgggctttgcagaggcagcccgcacagggattaaggatgtggctctgcagtcaaagcacctgtcccaccctagcttcatccttaccccagcagtgtgagcagacgagttatttaacttcaccgatgccccaccagtacaatgaaaagaaggcctccctaggtttggcacaagatattttaaatgagcacaaactgctaacaaattaaggtctccccttccaagtaactaaggcaaaagtaaagcaggccagaaacattcttcacaaaactttaatcaagtagaaatttcccttctattccccaccataactcacacatgaaaaaaaaaatctcatcacctcaccaatttaaaaaagaacaaatgtgcaaaagaataattatgacacaaggctgagcaccagttctgctttccctacagttcccaaagagaaggaatgtaacttctggctgcaacacgcatgattaaaaatcatgccaagcagcagggcacagtggctcacgtctgtaatcccagcactttgggaggctgaggcgggcggatcacgaggtcaggagatcgagaccatcctggctaacacggtgaaaccccgtctccactaaaaatacaaaaaattagccgggcatggtggcggctgaggcaggagaatggtgtgaacctgggaggcggagcttgcagtgagccaagattgcgccactgcactccagcctcggcgacagagcgagactccgtttcaaaaaaaaaaaaaaaatcatgccaagctacatctcccatcctaaacattcagagggaccacagactggactacagagcttcttacaacacagtttagtttgtggtgtacctggtcaaacagattattttcacaccctataaaagaagatacaaacatcactgccctttaacacacactcaatactatcatccccattttacaaatgagaacaaaactcagagaattagaaaaaaaactgaagtgaagtccaggctgagagactgtgtactgttaatatcacacaaaaaagcaacacaggccaggcacggtggctcacgcctgtaatcccagcactttgggaggccgaggtgggcggatcacgaggtcaagaattcgagaccagcctggcgaacatagtgaaaatccatttctactaaaaatacaaaaattagccaggcatggtggcacctgcccgtagtcccagctactcgggaggctgaggcaggagaatcgcttgaacccaggaggcagaggttgtggtgaaccaagatcgtgccactgcactccagcttgggcaacagagtgagactccatctcaaaaaaaaaaaaaaaacaaaccaaaaaacaacacagaataatgacccaaacaaattttttatttttttagacgctgtctcgctctattgcccaggctggagtggaggggcaggatctcggcccnaattaaaccctgactcctcatatataagtgacttctaatatccacaccggctgggcgcggaggctcatgtctgtaatcccaacactctgggatgccgatgcatgcagatcacaatgtcttgagatctatacgaccctgggtaacatggtgaaaccccgtctctactaaaaatacaaaagttagctaggcgtggtggcatgtggctgtaatcccagctactcgggaggctgaggcaggagaattgcatgaaccgggacctgggaggtggaggttgcaatgagccaagatcgcgccactgcactccagcctgggcaacagagtgagactctgtctccaaacaaacaaacaaaaaaaccactgtgccccatatttgaagagtaaaactctagagcaaaatagacatcgttcctgactgcacagaggtcagagcatactatgggaagagatgtaagtaagtatgtggttatcaatctgatgcgagctgtaagaaaaacaaacaggatgttaggagagagactaatgtaagaatggacttgagatgggatgatcagggaaatataaatcaaaattgtaaatataaaaacaagaccagacatggcagctcatcctataatcccagcactttgggaggccaaggcgagatgattgcttgggcccaggagactaaggctgcagtgaactgggattatgccactgctctccagcctgggaggctacaagaccctgtctcaaaaacaaacaaacaaaaaataccttttttgggtcaaaagccctcctggtacttatttatatgcaccaaacaaatatttgctttaaaccctccaggaccctgaatgacgtctggttttgtttcctttccaagggggaaagtgaaggggggtttcctatggtgccactggctcactggctgaaggatcaagcccccttttacttctcagtgaggaaagctgcagcttcctaaaatcagattggttttcttactaaaaatatctatttctccatatgatgcaacataaacattgcctcgaaaataaaaatactcctcagagaccattaaaatgtatcatacatttcaaccgtgttatacaaatcagacaggcaaaacaattcatcgggccgacctagaatccactcagttcaacaaacttatgaagaacctcccagagctgccaggcactgttcgtggtgctggaatactggtcatgtccagggaacactagagggcgcatgagagcttctactttcaggaaaatcagtcgttgagtcagggaagaaaaccaaacagatgcataaggggaaaaaaagttaacagggtagaaaagtacagactaggaagcagaatgacccttcactgaatgggccttttgcgtaaggcctgagaagcaagccgagtgccattagagatgtgctgaccaggcattcctataaaggtggcacaaggtagaaacacaggtgtcacaacacacacattcggtttctactggttcccctaacatgcaggactcgggattcgctagctcagcaaccctatcaggtgaaacaggtattagcactacaacaaggaggctaaagctcagaaacaaattgctttcctaaactcaaagtgctactaagtggtaagggtgggtctaaaaccttcatctttaaactgcagtctggggtttactccagtgcttgagccacgtgtaccacctagaggtttatcaccagcaaatgatccccggatctaggtactgttttctttccccctttttttttttttttaagagacggagtcttgctctgtcgcccaggctggagtgcagtggagccatctctgctcactgcaacctccaactcccgggttcacaccattctcctgcctcaacctccggagtagctgggactacaggctaatttttgtatttttagtagagacggggtttcaccgtgttagccaagatgatctcaattcctgacctcgtgatccacccgcctcggcctcccaaagtgctgggattacaggcgtgagccaccgtacccggccggtactgttttctttagtgtgctattacaacagacaaactaagacagcttatagaaatgcaactggcattgtaggagtcatacaggcccccaatcaagctttggggggggggacactgataccctagtctctcaattctaaaacccaactgattaactatctcataatgacatttcaaaaaaaggaggtaaaactacatgaaacatgcagatgaactaaggtgattagagagatgtcaaaatatgattaaaataattattaggagaaaataggatggcagtgaagtgtaaaagatgaagcattaatacaattttggattggaagtgacctcagagtcgttttgtagacggagtctaggccctatcaatgacttatacaaacagtgatagagcagagaatggaataagaattgattcttattccatggtccttcaactattcctaaaattacacttctatacagcagtcatcatttgacatacggccctagaagatggcctggtgttcaagtctgtctcattcggagaccggctagccccaaatcaaccccatccagacacataatggatcaccccctgcatttacttaacatgcagtattgtagctaacagggtgatggagcggagggaggacacatggtccctatcgtcaaaagtgtgaggaagattcttaaccatcagagcgttctaaggctgacatagtcggggaactcctgaccacggagaaggattttgccaatggagagatttgccaatgtaaagctcatacatggtacacagaaacacgaaataatgggaccacggcgatttatctgaaaggatttgctctgtaagccatgggaagggcattcctgtggacagggagctgcttagatgccacacacacaaatctctttatcacacaacctggccacgaacccaggccctataaacccacaaactgataatcaggtaaaggaaaatcagattcaacctcctttttaaataacccaagagaaaaatcaccaacatcccccacccactaaattctctgctgaaagacacgcagacaccgggacacttccttcacacgcgtctctccctgtcagagtccgctaccctccatccacctccaccttccccagtactgtcccctggcatttgctgcgagaataaaaagttcactgcatgagcagttcagggtgtttgggaaagcagatgaaaataaaggcgcgagagcacttggaaatgatcatggataaagaatcaagccctaccctactctcttattgaagaaatatctaccatattcccttcactctccagctcagtttttaaaatataattatgtttgtaaacaacattaaagtggatttattttgaaaaactaatacaaactattaagcttgacaacttggagattaataaattaacccattcattaagggtctatgagcacctactctgtacctgcccgtgggcggacgagataacaagagactcaaaaactcacgagtaaccaccccaacggctgtgtgtgtgaaggtttcaccaggaagcaacattctcacggggcctttctgaaggacaagagtgtacggggtggagaaaaggggtggaggaatgccgggcagggcacggccgacagggaccaggtatgggaagctattggagccagagcttgggagagggaccagaatgtcgaatgtttagagattacaaagtgaaaaatgggctggagttcccacacaagccgggattagagcgtttgtggactctaacctgggaatataaggcgctccaagagggacagggccacacctctggttcaaattgctaaaccttcagatacacaataaatctgtatttacagcaagcggcaatttatgtatttcaacatgcacacattatctgtaattatttcaggtaaaaatggtttcctcctcttttgaaaatacttctttttactactaattatcaatattataggcgtgttctcaatattaaagactaaaggaaaaaagttatagctggcaactgcttcctctaaagatcctacacagcaaagttcagacctgtatggccatcctcaactacactttatatcaaactggtttaaatcgaaaaaggtccacatcacaaagaaccacaatcaatcaaattaattcacctgccctctattctaaggaaaactccccccactccaggtaaatttcatttggcaaattcttaaaaattaacttcaaagaacacatgttcacctccccagtattccgaaagttccaccacttaataaatcgttaagttactgttccagacccgggtccaataaacccaaatagactgaatttctcagcacccaacttgtttctatcttaatccagcaagttgcatcgagttgtcattgttcctccttccaaggcggaggtgacaacggtgcacatcatccgcgaatacgtggaaggacagacacacaccaggggacgcagggagagcggataaagcacaaaggggacgcatcggccgcggggtcgccgggccacggccaggggcgccgtcggggaggagggtgggctgcacgacaagctcgggagggctccgaaatgcgctcgggccaaaacaaatacaaaaagttcagcgcggcagtgggagcatattgggcgatacggttcactgctgccctttgggagaaaaaggaaaatagattcccccaatcccgaacgggggggcttctcccctcttctcggcttcgggctcttgcccttaatcttctttggcggtctgtcatctatctttttttggctgtgtgttccaattacaggttatgtttctgtactctctcctgttctgacattaatcttatacactcttcaacattccttcactctgctcggattctttgcatcctctattctttaccaccttttcgcctgattctttctgatcccttcgctctccaatctctcttgaatgtcatgatctttctattagtcgttttgcatactcttctattctctccctaccttcatatgctctcttctatccataccttcttcatcatatctattaccttcatctaacttgtcattactattgtgtccagcatcttctttatactctcatctacatgttactctatctacttaagttctgttctacaactatattgacctcatagcttacattacgtacacgcatctcatttcagactagcgttagtcttc

SEQ ID NO: 26 - DNA, 45063 bp, Homo sapiens
  unsure (2110), (2134), (31256): Identity of nucleotide sequences at the above locations are unknown.
tcaaagagcagagcatgacatgtctcagggcctgggcccctgtcttgagactgcagagactctgtggatagagctctaagcagggctgccctgtcctgttgctgggttgtgcactcctcaagtgcccctggctgagagggtaagtggggctgaatcccagcccatgctgtttgctgagtcctgcgtctggtcctgggatgtactcctcccaccttgataatgtacgcaggacctagcagctttcctgaccataggggagggggtggctgtgtggttttgaggccttttttctgcggggggcggaggggggtccctgcagggaggcctgcaaagcctgagttctctccctgaggtggggagagtgaccaccaagttccatgcatgtcctcccgggtctgagctgcaccaaagtcacttctggtagaaacgtggagctccggctgggcgcggtggctcacgcctgtaatcccagcactttgggaggctgaggtgggtggatcacgaggtcaggagatcgagaccatcctggctaacacggtgaaaccccgtctctactaaaaatacaaaaattagcagggcgtggtggtgggcgcctgtggtcccagctactcgggaggctgaggcaggagaatggcatgaacccgggaggcggagcttgcagtgagctgagattgcgccactgcactccagcctgggggacagagtgagactccatctcaaaaaaaaaaaaaaagaaatgcagagctccctcacctctgtccttaaccatgctatcttcagcctcatctgggaaagaggcttccgggaacaggagcagggggaccctcagccaagccaggagctggatgaatcatgctggcttggcccagtccacaggggctccaggtagagggactctacagccacagtcctcccggaggagtttccccaactttccagcccctggcccgccgtggactgctggggttcctggttggtgcgggcccttttctgcccctcggtttgtgatcacactgttttctttaccactgtcccttggaaaacttccatgcatccttcagggcccagctcaaatgtcacctcctccaggaagcctcctcatgaagccttgcttcttagcccaagctcagtttgtcccttccgtaagtgctgctgctcctgactccattcaacacgtgtggattctgtcgtgcatcaaaacaccatttgctgagcagctactatgtgttcagtctctgtgtgttaccctggggtaaataagacagacctggctcctggccccgggggggtgtgcggtgagattatcagggaggggcaccatggcagatatgctgctgtccccagtgcccagcaaggacctggcatgcaggagatgcttcatgggggtttggtgctgggcgaacgtcctcagcgtggaggcctcagccagcacagcaggggagcagaggctgtctttggcattaatccctgagtagcttcctggtcccagctgctgggctgggggacatcgcccactctccaagctgctcacatacattagtagccgctggagatgggtgggggcttctcagcttcacaggggcaaggtgcagtggcagagtaggccttgcccatgaaccgccagggtcccctagccgagatgagttccctctggcaggctgtggaaggatcatccctccctgggtgcgtgacccccagccccgcccgacctcaggtctatcccggggcctcccctcccacctccgagctctgggtcccccgctgtaaaaagcctgcaaggctggctcagagtctggtcccagggcaactgtggggttggccgtggccccaccctactgggtctcactcactctcagctcacctcaaagccctgaggtgggagtcctgtgtagcccctttctgtgccagagcacacccagacttttctcttccagcctggggctcatcgtctgagggcagggctgcctttaagacatcgtggggttcggccaccccagtgcaagctgcccccaccacggcccctcttcaggcccaggggtgaatggctgcttgtaccaggtaaccgcagcccagtctcaagccattgtgtccctgaggcacctcgtccccntggagggtcggccttcttcccttntaatccccccaggcctctcccagggacctcttaaaagcacagatcccacgtgtttctctcccttgctcaagactgtctggcggccttctccttgctctcggagtgaggtctaaacccctcagcacggacaccaggccccacggggtctgcagctgcccctcacttcctctgggtcatctcccctcaagctcactgctcccagcaccgcccctgcacactgcggctcctcctgcctccctgtctgtacccaccgtgtggaggacccctcatcagccttcagacttcagctgaagcggcacctcctcccagaggatctccctgtttatctcatttaaagatggcccgctgcgtgtgcgcttttgaaaattgcaccataattcgcttactataaaatgggccctcttaaaaggatacacttcagtggcttttagtatattcacaaggttgaacaaccatgaccactttccaatttcagaatgttctcatcaccccaaaaggaaaccctatccccgtaagcagtctctccctgttcctccctcttcccaggccctggcaactgtaaagctgctttttctctctcaggacctgcctcttctggacatttcgtataaatggaatcgtgtaatatgtggcctttcgagctgggcttccttcactcaacgtcatgtttccaagatccatccccattgaagctggtgtcggagcctcactgctttctgcgggcaagtaacataccatccggagtgggttacgttggttcctttcatcagtcccttggtagcacaagtccagtttgtactttctatttttattttattttattttatattattttatttttgagatggagtctcactctgtctcccagtggcccagctacttgggaggctgaggtgggaggatcgcttaagctggggaggccgagactgcagtgagctgtgattgtgccactgcaccccagcctgggtgacggagctagaccctatctcaaagaaaataaagaaagaaagaaagaaacagaaaagaagacgagtgaaagtcctaaccgcctttgtctctaaaaaactgtttttagagacagagtctcaccctgccgcgcggctggagctgccatgccatcacagctcacctcagcctcaaacctcgggtgctccttgtgtgtggttgtcgggggagggtctgagctcggcactgcctccttgcaggggtgcatggtgccacctgcagcacgtttgcactccccgacccaggacagactggtggtgcccccttgccggcccctgcgcccctccacgcagggagatctgtgccctaggaacagctcccagccatggccagggaccaccgggagtggggagaacagcctgctttcccaccttcccgatacctctgaggcttgttctatgtggtctcccagaggtctccacggggcctagccccgctgccactgctgaaaacttgccttatttggcttctcccctcccctgcgccccttccctctttccctcccacccttcccaggctctccaccaaaacacactacttgtgctcaaatccttgtctcagcgggagcgtccagggccctggcctaagagctggcaagaccccagcttccaccccgctggctgtcctcccagctaggcctgactggcccctgcttctcctggggcttcacccccagtgcccctcccagccttttcccctctctgtacccccaaccccctctcccggggcttcaccccaggggcccctcccagccttctcccctctctgcacccccgacccctctcccagggcttcatcccaggggcccctcccagacttctcccctctctgtacccccaaccccacaggcctctgggctcggacttcagccctcactttcccgacgccaccctagtgactctcgtcccccaccggccccttccttggctgccaccacaagccatttggttcacaacatagcaaatggcctgggtctccccgaattcctgttgcttgtgtcatatgcaagagaactcaaaatagcacgtgcagcctgccctggcctgggaagtatctggttttcccaggggttggtccccagggcaggacaagggggtttgctcaccaacaccccatttttgggccctgtgcccagctcacacgctctccttcccctccagggccaggcttggctttcactgtgcccctcgctcactgtgtgacctcagacaacgcacacagcctctctgagtcttcatttcccagcgtgcaacacagggataattcctgggctgctctgggcagtagtttcaaggttgaagtgtgacaagggatgggagaatagctcatgagttttttttgttttttgttttttttttttgagacaagttctctctctgtcacccaggctggagtgcagtgatgggatcatagctcgctgcagcctcgacctccccggccaaagcgatcctcccacttcagcctcccgagtagctgggactacaggcatgtgtcatcacacccagctaatttttaaaattttttgtagcgatggggtctccctatgttgcccaggctgggtttgaactcctgggcccaagtgctcctcctgccttggcctcccaagggattggagaatacctggtgattttaaaacagcatttttttttttctcccagagaatgggcatgaagggaagggggtgggagggcagaaacctggcctggggccctaccgcatgtcccttctgtctgcaaacctgggccctcaccatcattatccccattctacagatacagaaaccgaggctcagtgagatcctggggttgccagagctcatggggctggcggtgggtgggtcagggcacaggctttgctcacatgaccatgaggctgacggtttttgctttcttccacgtgatcttagcaatcatcagagactgttacaatgagcacgtttggtgttattcattagtgcctaggacagttcatgatatgtagtaggtgctcagtagatgcgtgggtgaatgaatgaatgaatgaatgaataaaaccacagagctccccttagaaagaccgatacggatacatgacccctgtggatgcagctaaacagaggaaacccagctgcacgtgggcagtcggcctgacgcacccggagccggggaagtaaatatggccaagaagcacctggagcaggtcccgggtgctcaaccgcagacggccagtctccaggctgcggggacgctcgggtccttcttgggatgttcctgcaggggagcggagctcctgcctccccaggcattctccgtcttgggagacattgatttcagtgcagtgctggtgcctccaactcattgctggacctcacagaagccccggcagcctccccggaagacatcatttcttcctcctataaaataaagggggagagatgatgggcactttggccaaagtaacacaactggggcagtttttggaaacccagggaggtatttctgatattcaaaccaagttaggtgcaacctctgagtgccttgggagaaaaagctcccagtcgatggcaccagccctcggccttggcaggacataagggaccctcaggctgagccaacatcactgtccccaccaagaataagtctttctccactgctggttccaaaagacatgcgtgacgggcaacaaaagccacattggagagtgcagctgtgctgtgagggtcgttcttggttcatttatggggtagcggggcggggggaagaggaggacagagtactcttatgactctcctgggttgttttctatcctagggggagggtagggaatggggtttctgtgccagggaccccctttctcatcgacctcacacaacactggctcacacagctgggccagtctccttcgcaagaggaagccgctgtgttggggacttggacggcaatcctattcccagaagaggggtcttgtcctagaccccaagagtgtgttcttggatctctcgtgggaaagaattcagggtgagtcgcagagtatagtaaagttaaaacagtttattagaaaccactcggccgggcgcggtggttcgtgcctgtaatcccagcactttgggaggccaaggggggtggatcacgaggtcaggagatcgagatcatcctggctaacatggtgaaaccccgtctttactaaaaatacaaaaaattagccgggcgcagtggcgggcgcctgtagtcccagctactcgggaggatgaggcaggagaatggcgtgaacccagaaggcagagcttgcagtgagccaagatcacgccactgcactccagcctgggcgacagagtgagactccatctcaaaaaacaaaaaaagaaaccaaagaaaccactctaggccgggagtagtggcttgtgcctgtaatcccagcattttgggaggccgaggcagacagatcacctgaggtcaagagtttgagaccaacctgaccaacatggtgaaaccctatctctcctaaaaacaaaaattagctgggcgtggtggcgggcgcttgtaatcccagctacttgggaggctgaggtaggagaatcgcttgaacccgggaggcagaagttgcagtgagccgagattgtgccactgcactccactctgggggacagagcaacactccgtctcaaaaaaaaaaaaaaaaaaaaaaaagaaatcactcattgcagagtagggcctcctcaggaagcaagaggaggaatgcttctatcttaaacatagtgcttgcttatacaggctgttaaaaacagtgtgctttattacaaaggcttgtgatcagcttgtgacagactattagcattattttcctatgttactactgattttaataagaatttaccagtgtactattatctttaagaaaaacttcttctggctgggcccagtggctcacctgtaatcccagcactttgggaggctgaggcaggtggatcaccaggtcaggagtttaagaccagtctggctaagatggtgaaaccccgtctctacaaaaattagccaggcacagtggcaggcacctattatcccagctacttgggaggctgaggcaggagaatcagttgaacctgggaggcggagcttgcagtgagccaagattgtgccactgcgctgcagcctgggtggtagagtgagactccgtctcaaaaaaaaagaaaagaaaaaccacttcttcttcttcttttttttttcgtagcccaggctggagtgcagtggtgcaatatcagctcactacaacctccgcctcctgggctcaagcagtcctcccggctcagtatcctgagtaactggaactaccggcatgcaccactacgcctggctaatttttaatgtttttgcagagttagggtttcactatgttgcccaggctgggctcgaactcctggcctcaagcaatccacctgtcttggcctcccaaagtgctgggattacaggagcaagccacatgcctggcaagaaaaacttattcttaacccaagaatgctttttgttcttgaaagattggggcatttccatcagttctgggtcttcagttagttagcatcatcaactctttctctcaaccataaaaaacatcttgtgggcaagacagcccaaccccctggaatgtaacccagtaggtttggccttatctggcctttattcaagatggagtcactctgattaggatgcctctgacaatcccagcgagctgctgtgggttgaccagtgtattagtccatgctcacattgctaataaagacatacctgagactgggtaatttctaaaggaaagaggtttaattgactcacagttcagcatggctggggagacctcaggaaacttacaatcatggcggaagggaaagcaaatatgtcctttttcacgtggcagcagcaaggagaagtgccgagtaaaagggggaaaagccccacttataaaaccatcagatctcatgaggactcactaccacaagaacagcagcatgggggtaactgcccccatgattcaattacctttcactgggtccctcccacaacatagggattatgggaactataattcaaggtgagatttgggtggcgacacagccaaactacatcaaccggcctgggtcagcctcaccctcctgacatcatcctaccctgggtgggccctggcctcgtgtgaagcagtggatgacataccagggctgcttccagacactgtgccaccagccctctgggcgatgcaacgtcacaaagtccctctagcctcgactttctcatctgccaactaagaagagtgacagtgtccttggctcacaggctggctgtgagaaccagatgggaagtggggtgtgggatcttaggaggcataggagcaggcgtatacctaaagtctcaccactgtaaacttccacactacatattgtggtaggccaccttctaagatgacccccaaggactcctacctcttggtggtcacagctttgctcttccctccccttgcaggtgggctggacctggtgacttgcttctacctgatagaatacagcaagagtgatgagatgtcacttccgagattaggttggacggatggtgacttccagcttgttagtcttctctcgggctcttcttgtttgcttgctctggtgaagccagccaccatgtggtgagttgccctgtggagaggcccatatggcagggagctgagggaggcctttgggtaacagcctctgagaaactgaggccctcagttcagtagctagtgaagagctcaatccagcccacagccactgagcaagcttggaagaggacccttccctggggcagctttgtgctattgtaatataataaagagtgtatatctggttttcatctagggttcctggcatagagtttctaaaaccactggaatttcctaagtaaaaggggtgagagaagtgtcttttgttactcataataagcccccttcaaccatacttgagtttattctaatgaggtgactcatggaggttgggggctggtagccagaggaaccaaccacgtgattgagggttgcaactttcagcctcacccccaacctccagggaggagagaggggccagagattgagttcaatcacccatggccaatgattcagccaagcatgactatgtgatggaacctccataaaaacattgggtctcatgagaacaacagaatacagagagctggtttggtggacatatggaggctctgggagggtggtgggcccagagagggcatggagcccctctcccatacctcgattatacatctcttagatttggcttttcctgagttgtatccattataataaactggtaatggtatgtagattgttttcctgagttctatgagccattctagcaaattatttaacttgaggaggagattgtgggaaccttcaatgtatagctggtctgtcattagtgcaggaggccctggactttcaactgacatctgaagtggaggcagtcttgtgggatcccttaacatgtgggatctgcattaactccaggaagatagtgtcagaattaaatggaattgtagaacactcacttggcgtccagagagttggttggtgtgtgggaaaaaatatcccacacacttggtgtcagagatgtgagtaaagacaggtcagagaccttgcgatgattgcagccctggctgacaccttgattacaagctcttgggagacccagagtctgaggcactcagccaagctgcattcagattcctgcctaagaaaaactaggagataatcagcattgttttaaaccactaggttttggggttgttatatggccatagataactaatacacatatttattttaacatctcttagaaaaatagaactaacacatcaaattgagttttagtgttttattacttgcaatgaaactaagtagagaaaatgaatcaatgtaaatcaatttgaagagaaccgtaagataaacagaggtacagatgggtgtgggatggcaaacagcaaggggtagaaggacaatgactgaagtttggtaagcactgagctaattgagctgaccgtgattccaaagccatagtatgcgtgctcagtgttaggaataatgaagggttacctctgtctgggtgcaggagtctacagggtgcagcaagtgcctccacccccaatggtaagttgtgccctgctgagggggctgcatatcaaaatcatctgggttcccgctgcctgcctcccatagctccctcccgtccctagctgcttcttgccttacccccagcctcagtgcaggcagcacacccatcagggaaggaatgactttgtgacctgtttgctgtagccctgtgtccagtggcctgaggggactggagatccaggaaccctggttcttttttttttgttttttgggatggagtctcgctccgtcgcacaggctggagtgcagtggcacgatcttggctcactgcaacctccgcctcccaggttcaagtgattctcctgtttcagcctccccagtagctgggactacaggtgcacgcaaccacaccaggctaattttttatatttttagcagagatggggttttgctatgttggccaggctggtctcgaactcttgacctcaggtgatccgcctgtcttggcatcccaaagtgctgggattacaggcgtgagccaccacacctggccagcatccctggttctaggatggcttctgccatcacctgaacaggaattgtggaagggttatttctcttcgctgggctgaggaagaggaacagtggtgggtagggtggaagagaaaggagagagaaagataagggtaggggataggtgggacagggtcaaaggacatcactgccctgcctcgagtccactgcagaactgcctcccagtctgtggcaccagaaagacccatggatggggcaggcaggaggactggtggcttcacccaacctcggctgcagataaggggagatcttggccaagcccttcttgcctctgggctcagtttctccctctctaaaaggattgcggaggcctttctggactgtatagccttgaaggggaggtggccagagccactgagtctctccccttcttctctgggtctgggaaatgctgtcatagcctcctctttctgggttctgtctcctccactggaccagacagacaaggagctctgaggatggggccgggcactcagactgtgcctactggaagggtgcccccttcaccaagtgcttcccattggccccgcttctgacacatgtcatcttgttcgaatcctccctacagccatatgaggtgcaattctctccccactttacagatggggaaactgaggctcagagagggggtgatgcgcccggcatctcacagctgggccagtgtaggtgtggaatcagcagagccagcagtagatccccattttgccctctcctctattgtatccacagcacctagaagagcacacagcacctacgaggcgctcagtaaatgcttgctgggcagggcttgctggggggtggttcctggtcaacctcgcagagcaactggccccgaaggagcagctcgagccagggcctggacctccgctattggaggcacgtgtgtctgggaagacccccttcacccagcacagggggcttgggcttgttacacccccacttcacggaagaggcaactgagcagccgaaaagtgctgtgacttgcccgaggtcctgcagaggctgggctggtgtctcactagttttttcttttttgagatggagtctcgctctgttgcccaggctggagtgcagtggcacgatctcggctcactgcaacctctgctccctggttgaaccaattctcctgcctcactcagcctcctgagtagccgggatgatacgcgtgggccaccacgcctggctaatttttgtatttttagtagagacggggtttcaccatgttggccaggctggtcttgaactcctgacctcaagtgatccgccctcctcagtctcccaaagtgcagggattacaggcgtgagccaccgtgcctggctgtgtctctctagttttactcccaggctagcactgctcccttgatgacaggtccctaagccagggcccagaacacccacaaacggtgactgccaggctgctgtgaggatggtgctacccagaggggcccctacactagctctttctctccctcccgagacccgtaagtacgtggcgacagactcactgaatgccggtgagggacacagcccagatgccatctgtccgtgccccattctggctgtgccaggaacaggacattgccatcccagtctcagcgccctcttgcgggacctcactgggccctgcccacattgtttgtttctgctccttctgagctccctcctgcatcacgctccacatggtgtaactgcttactgggaaccacattccactagggcctctggggttgtgtacccaaacatcaagggaattctttagcggcaataaagacaatttattgggatgtgccgtttttgcagacagctgcgtgcatctattatttcctttcttcgaaataaaaatatcttatactttttttcatgttttaaaatgtatgctccttgtcacaacaaaacaaaacaaaaaacaaaacaaaaacaaaactcaaacctgtggccacatcctgagatctctctcgaccccactctgttccccagagctgtgtcatcttttaaacatttgctgacttaggagttcagtgatttcattgttactttaatttgcatccctttgtagcctaatgaggtggagctttattttaggcattcctcactgatatttcctctttcttgggaacttctggttcaagtcttttcccatatgtggaatttaaggctgaatgtatgggattttaaaggctctgcaggaagcagaattttggcacccatgatcttcactcctggtgtcctgcctgtggttgtgctagatgagatggcaaaaaggattttgtagatgcgattgaagtcacgaatgagctgatcttaaattagggagatcatcctagattatctgatgagcccagtgtaattgttaccagaaagaggtcctgatctagatcccaagagagggttcttggatctcccacaagaaagaactcagggcaagtccacagtgcaatgcaaaaacaagtttattaagaaagtaaagtaggctgggtgcggtggctcgttcctgtaatcccagcactttgggaggcctaggcgggtggatcacctgaggtcaggagttcgagaccagcctggccaacatggtcaaaccccgtctctactaaaaacacaaaaattaactgggcgtggtggcgtgtgcatgtaattccagctactcaggaggctgaggcaggagaatcccttgaacctgggaggcggaggttgcagtgagctgaggtcgtgccattgcactccagcctggcgacagagcgagactctgtctcaaaaaaaaaaaaagaaaaaaaaaagaaaagaaagtaaagtggtgacagaacagctgctccatagacagagttaggacgttccggaaagtaaggaggaacgtgtccaccctaggtataatactcgtttatatataggatgaaaaaagatcaaagatcatgaggacacgtgctctgccactggggtttgtgataaagaattttcctaattactgtattttgcaagaattgatattattacctttaaagcaaaattagggatgcttctgttctgaagatatcaggatatcagcacactcccaagtctaggtctgcttagtaaacattatcaatctgttcccttaactgtgaacgcctcactttctgggaatgcagcctgataaagccccagcctcatttttcctagtcctcactcaagatggagtcgcagcaagtcccagcctcattttccctagtcctcactcaagatggagtcgcagcaagtcccagcctcatttttcctagtcctcactcaagatggagtcgcagcaagtcccagcctcatttttcctagtcctaactcaagatggagtcgctctggttcgaatgcctcagacataatcatatgagcccttggctcactgcaacctctgtctcccaggttcaagcgattctcctgtctcagcctcctgagtagctgggattacaggcgcctgccaccatgcctggctaatttttgtatttttagtagagacggcgtttcaccatgttggtcaagctggtctcgaactcctgacctcaggtgatccgcctgccttggtctcccaaagtgctgggattacaggcatgagccactgtacctggcctgaaagcagagtcttgacgaattatttgtacactcatgttcacagcagcattattcacaatagtcaaaaggtggaagcaacccagtgcccatccatggatgactggataagcaaaatgtcatggatacatacagtggagtattattcagctttaaaaaggaaggaaatttggacacatgctacatggatgaaccttgaggattttaggctaaatgacataagccagtcacaaaagaacaaatactgcaggattccacttaaatgaggaacctagagtcgccaaaatcttagggatagaaaggagaatggtggtttccaggggctgagggaatgaggagtcagtgcttaatgggtccagaatttcagttttgcaagataaaaagagttctggagttggaggtgatagttgtatagcatcattaatatatttaatatcaatgagctgtacacttcaatatagttatgtgaactaaaaatatctgagacaggtctcgatctatttagtaagtttattttgccaaggttaaggagtgcctgggaggcaggtctatgccttccttcaaggatgatttgtaggacttcaatatttaaaggggaaactggccaggtgctgtggcggaggttgctgagtgacctgagatcgcaccactgcactctagcctgggcaacgaagcaagactctgtctcaaaaaaaaaaaaaaaaaaaaaaaaaagggaaagggtggatattgggaaagagggagaaattttaaaaatatgtggagagataagagacaaaggttgcattcttgtgagtctttgatcagactttcactgaaatacacaatttacaggttgcgggggtagaggaatagtcacttatgccttagtctggctcggtgaatctgcacttttataccagaggaagcaatcaggtgagcagagggatgacttagagttccatcctttgtttggaacctgtgaagatcagttgtcaatgtacattgttagggtaaaattcaacaaaactgttttagggtaaagatcttgggggcccacaaaaaatttcctagcgggcaaattgtgagggaggtatgtagctttttaaatcttcgtagctattttattaaagaagaaaaggcgaggcagtttgcccaacgcagttcccagcttgacttttccctttggcttagtgattttggagtcctgagatttattttcctttcacagttatgatggtaaattttatatttattttaaaccctcccccctccccaaaagagggggaaaaagtaaagaggtatggcagaaggggaagtcacagagattggaagcgtcttgcagcacctttttttttgagatggagtctcgctctgttgccaggctggagtgcagtggcgcaatctcagctcactgcaatttccgcctcccgggttcaagcgattcccctgcctcagcctccgagtagctgggactatagacacgtgccaccacgtctggctaactttttgtatttcagtagagacggggcttcaccatgttggccaggatggtctcgatctcctgacctcgtgatccacctgcctcggtctcccaaagggctgggattacaggcgtcttgctgcatctcgaagcgtcttcagcgtgctcttgcttgctggctctgatgatggaggtgttcaagccattgtggaaggaatgcagtggcctctaggagtgagaatgacaccagccaacatccagcaagaagacgtggacttcagtcctaggcccatggagacaattctgttaacatcctggatgagcctggaagtgggctttccccagagtctgcagataagagcccacggcagctgacattttgactctagcctcgtgaggccctgagacaggaggtttcctgccccgcaggactgaaagatgatgaatgggagttattttatattttcagattgtggtaattagtcactgtagcaatagaaaacgaatacaaggtctttatgcattaatgttgaaaacactttttatatacgttgtaaatattttttaagtgtgtcatatgtttttaaacttttcccttaatgatattgaatcctcctaatttcaccatcagagggtaaactccagttccattctggggggagtcctttgcagtcaccccgtgtactcaatactcacatgcatcagaatcaccccgaatgcttgttaaaacacagattcctgggtcctccccgcagagttgctgatttagtaggtttaagggcccaagaatttgcatttctaaaatgtttccaggtgatgctgaagcttctggccggaaagacatcctttgagaacatatttcctccccagccctcggcccttaagccccagaacgctgccccgccctgggtggaacgaagctgagctccaccctagaggggcggggccctttagctccgccccactcaggagaaccccacccctccctccccgttctcattggctgggactgcagggatcccctgcgccacagtgccgtgcgcgcgtcagcaagaacgccagggacggggtctccgcgcctgcgcagtgaagctgggcgccttcggggcttgagcttctgagggtcgggtccagcgcgtgggctgctggatggcggaaccccaggcggagtcggagcccctgctgggcggggcccgcggcggtggcggcgactggccggcggggctgaccacttaccgcagcatccaagtcggccctggtgagccgcccggacctggggaggggactggcccgggagaccagggtcgcgcgtgggggtcccgctgtcccagcaccccgctttctgccgggcgcgcccccaccaggttcgagtccgagcggggcccgggccgcgccgggtgccaggcgagccggtgttctgagggcgagtgggctgcgtcctgcggacccggaccggggtcagggcagagctggggtctcttccgtgtcgcgtcctgatcccgaccagccgggcgaagaggccctcgcccagccttgggcagccccgagggaaccggccacctgcggcaggcaccctccgtgtgcccgggcgggcccagaccccatacttcccgactgtcgccgtaatgagggtcgcctaattgactcagagaaggcagcactttgatttttcccgtttcttctggaaaaagcagaggctcacagagaggcgttaccctacccaaggtcacacagccagtaagtggccgaggtgggattcgaaccagttgggagctaggagtcctttctttgtagggtgcctttccccgtcccacttcccgtggggctggggcgggccccctagacgggggcggcttcctctccttgccctctgccaccccagagtcccctctgcactccctcctgcccttcctgttttttgtcctggtctgaagattgctgaatccgccccccgagggtggggtgcgtccgcccctcgctgacaccaggggaatgagattctggattaagaggtggaaggaccttagcttcacttcacagatgaggaaactgaggcccagagaggccctgagacctgcccaaggtcacagccctctgttctggtgcggctgctgctcgaaccactctgagaattcacacctggctccttccctctctggcctctctttccttctttcctcctctgtctggaaggaactgggttggaatcctggtgcccacccactggtctgtggcatgtgcccatccatggagtaatgaggggccaaggaggggaccctgacgagagatgaaaaaccagaggccaaggtggccaccctgtctgctcacctcagaagctgcctccaggaagttcttcaggtgcttcctgggaccagtcaggaaggagatctgcagggagcagctctggcaggccccttgatgagacgcccagcatatggcaccgttcagggaacacagactttgtgtctaggggtctgggcgcctttctggggctgcactggctgtgtgaccttggcaggttgcttaacctttctgtttcttttttgagatggagtatcactctgtcacccaggctggagtgcagtggcgtgatctcggctcactgcagcctctacctctgctgggttgaagcgattctcccgcctcagcctcccaagtagctgggactgcaggcgcccgccaccacacttggctaatttttgtatttttagtagagatggggtttcaccgtgttggccagggtggtctcaaactcctgacctcgggtgatctgcctgcctcggcctcccaaagtggtgggattacaggcgtgagccactgtgcctggccatgcttcacctttccgaatctcagtaaaagggagataatactaaggactgcctggcgggcattgtgaggattcagagagaatccagagtttgtcctcagcacagggcccggcgggctggtgtgggggccagtggccgtcctgggtaagctctgtgatcattgcaggtcctccctggcaggtgagacccgctctgctgggcagtgtggctgacaagaggaggctctcggggagcgctctttgtccctatgctgtggcctcagccagggcttctgagaacgtggacaggacgctctgtgttctgaatccccttggccagggtccccagcaaggactggcagactatggagccgtggagactccgaaaggctcattcagtctctgtgctgaggcctgtgccaggctttgaaatgaaggccctgtgctctggtttgcaagtcctgtggttggtctcttgccaacgggttgtggtgggggctgctgctgtgggtgccccaaggaccccagtggaccctgctgttgggtcgttttgacttggccccacctgatggggccggggtcaaaggttgagaacagttgttttctcttgtttctgggtcagaaaaatcacacttttactggttatcaaacaagtcagaggacaagggattgcgatgctgtagaggctttcagagtaactgaatgcttatgaagggctcacttagcaaagtactctggctatagtaagtcattcagtctgtacttagctcctattgggtgggggtccatgaggacctggagcacctagaggttgagggacttgcccagggtcacagaggatgatggtcaggaccctacacaggttgtgcagcctggagcctggagcaacaggggagcgggagctcagacctggatgttgcggggcagaggcttggattaggaagccgtgtcgaggcctggtgtgccggatgcagtatctcagcccctgctgtcctctgtgccttgcagaacccttcagccccagtgggtgatggtgtgtggaaaggtgattgtcccccagggtgatgagctcagggcggggcgagctgtcccaagggagtccctggactcacaaattgggggatggtgctcctggcagaagcagcagcctgagtaaagggttggaggctttggagagcatggccttggcagagcccagttcggaatgagtggcactgagggttgaaaggcaggagagaggcgggccggcaaatgtgggaacctgcagtgccagaccagggtggagtgtgggcctggaatagtgggggcccaggggaagctgcgatgtgcttctgagtgtttggaacgagatccttgggctgttgcagggtgaaacggaggatggccagacccagaattttacaaaccagcaaccaaaaagccaggcgaaagggaaccacgagtgctggatggttccaggggtgcccaccactgttggcctgggatggctggcctgggtggatgtgagtactttccgtggtcctggggctggagtgaggcccggaactcggccgcttgtctcttgtctaagaagcttgtatcactagatctctcctggtagagattttgtcttctcccagggaatctggtaaggtggggcctctcagatcaccggccccccaggctcccctcagggctgttcatttattcatgggatatatcagctttgagtcctgtgtgcttgacttctgggctctgcagatacagcagggaacaaaacagtgtggcttctgttcatagcgatcccaggatgtgctcaggggacataaacagtagccactttcagagcttccctggggagacattcgggtgtcctcagggtgggtctcgtggctgtgcatgtgggcaccaaagccacagggagggaaggctcttgctcccggcagtgcagcagggccgggcagagcgagggtggggtccggtctcctgcctctgtctggggcccctcacacctctaatccgtccagggcccagctgcctatacctcatgcccccaagcaggagccccgaggacaggggcagctgcctccctaaggatggccagtggcgtgggcgggtcatggcctggagctctgcctggggaccagcacctcctgaggcctctgctgctgcctcccatgtcaccacattgtcttggtgcagctgtgggccccaaggggccaggtgtgaaagccgagtctcaactgaaaaagcagctgcttcaccctctccccgtgctgggaagtgtcagcctctccgggctcctcagttgcttcgggttgagtttttcttccctgttggcctgctggggagcagctctgcagcgaggccagaggtggcccgtgcctacgatgcgggtgggtggcccaggctccctgcagtggctcagtggctgaccaggtgcgcccgctggctgctctgtggcaggcgaggggcttgtgagcaggccagggtgctgggtcctggcttctgtgccgcctgacttttcctgaaggcccctcctagtcaggagccactgccgcttttgcccaggcctgccgggaggctccaccctgcttgtgctgttggtaaaggcgggcggccacccttcaccacagaaggcaccggcagaggctgggggactcgggcgttcctgcagctctgaccctgggagtgatttgggtgggcttgcctgggcccatggaccgggacagtgagggaatgggaccttggtagcactcatgaagcctcatggcagtgcctttgggttctagatgccagttctccctgtcactgttgaatccgaggtctggtttgatgggggtgggtgggacactgggtacagtgtcctggctcatgaagactgtgcaggagccaggtagggccgagcggaagaggggtgacagcagccccaggtaccgagcatgcctggggagcgtggcagggggctcttgtgctcctgcgttgcacctcacagtaccctctggggagccgattgggtggctgtaaatagccccacttgacagaggaggagccagccacagccttcctgccagcacgtggaggagccgggctctgaaccccgacgctggtgccagggccctgcaggatgtgccgcttcccacaggcttgctagttgtgtgcgctgcatgcggaggtgccgtgccctgggcctggcctgtgcatttgatgccgaggcacttacctggtttggtccctgccctgggcaggtacatgcagccccactgccgggtggagtcatctctttacaaacggccttgggaagaaccacagccggcatctttccttgatcacgggtatcctggagggtgaggccatgtcatcctgctcggtcacctgatgtgtcccctctgcctgcaggtgccgcggccaggtgggacctctgcattgatcaggctgtggtcttcatcgaagatgctattcaggtcggtggcacctgctccctgtggccgggcctggggggtggccgccctccgattggctcgcccctccaggggcgactgactgcgtccaaggcctccattgctggactgtaggttaagagaactgagggtggagcctctgggcacggctcttcgtcagtccccggaggacttgtcttctgcatcctggacgcatttgctgctttgatgcaccgtgttctgaggcctgttgtggaccaccccattctaggtcccgggtgggtgggggcatcctggaggatgacacagctgcacggggcatgggagggtcagccttgcacagagaagagagagcctcgcaggcagacacgggcacagctgtgctctcagcaagtgttccctgagcgtttgctcacgcacccacccaccccgggtgtgtggcctgtgaggtcttgtgtgttgggcaaacctcgtggtttgtgatggtgtgggcctgatgggtcagggctggccatgtccacacgctgaagcgtcccctgtgatccacagcctgagacttgggcctgtctcgtgtgtggtgtggggctcgggtcacggcccaccctgcatgcacccatgtcatgcctcatgtgacttttcgcttgtagtaccgctccatcaaccaccgggtggatgccagctcgatgtggctttaccgacggtattactcgaacgtatgccaacggtgagaacgcacccatgtggaactcagggttcctgccggcttgcgtggcaggggaggctggcccccacctggggatcacctggtctcagggtccaggcaggctccccactacatagatagggcggttaccatcatcctctctggaaaggagacggcctgtgatggcaggctccttctacaacaagggttcctttctggaatgctgtggtcagccctcggcaatggagctttgagcagattcgtgatctccccagtcacgagtgtccacgctcaggcagcgccaactcccgtgcttcggactggggaagctcctgaccagcctctgggccctgagggctgctggctcctgtgttttcatgtttctgtcccctttccaggactttgagcttcaccatcttcttgatcctgtttttggcttttatcgagaccccatcctcactcaccagcacggcggacgtgcgctaccgcgctgccccctgggagccgccctgcggcctgaccgagagtgtcgaggtgctctgcctgctggtctttgcggccgacctctctgtgaaggtgaggcgggcgccaggccctctacgtgctgccccggcctcccagcgcctggccgctgctctcctggtttattgctgattctctggagtgagctgccttttccccagactttgtactttgacccggtgagcaaggcacactttcttggacaagcaagtgcctgaggcagaggctatgtcagctctcctccctctccaccatgcaaactgaggccagtgtgccgtcagctctcctccctctccaccatgcaaactgagcccagtgtgccgtcagctctcctccctctccaccatgcaaactgaggccagtgtgccgtcagctctcctccctctccaccatgcaaactgagcccagtgtgccgtcagctctcctccctctccaccatgcagactgagcccagtgggccgtcaggggttgcgcaggctggcagggcctctgggaacagtccagtgtctgcagtgctgctgtgaggagaggtcccaagtgaataagtgaggcccaggtggtccctcctcaaggctcaccctgccaccccaaagagaagaggagaggaggtgggcgtggggcagaaaggggtttcttatgcacacagcagctgctgcatgtttgactctgggttctgcctgtgacgcacgtcctcccacaagctggaggtgggcctttggtgctcacctaagcttctgagcctcgtcagagacttagtgcctttccagggaggtgcaggctacgttttctatttttgtcaaacagtgattccagtgctgcggtctcaggggcccccacatccatgcccatggtgttagatcaggccctggctgcagccgtcctcagcgccagccctgccgctccttggctgggccttgggctcacgtggcttcctggtcgcatggggcctctgcccggcactgccctgtagtcccttgtgggcagggcgggctgtgtgccgaccgagggttgtggctggatgctggtgtgtgtgattgcaggccccgggcagtttctcatttcttcctttgtagcttatcatgtggttagcaggtctgggggtttttcaactggaactgaaactggcaagaggttgtcattagcgttttttgaatggttggtgtgtttgagaagcgtcaaaaggtgagagagggtacatcagcaagctgtgacctctgggggctgtcttttattttattttatttatttattttgagacacagtctcgctctgttgcccaggctggagtgcagtggtgcagtcttggctcactgcaacctccgcctcctgggtttaggtgattctcctgcctcagcctccccagcagttggaatacaggcgcgtgccaccacgcctggctaattttttgtatttttagtagagacgggtttcaccatgttagccagtatggtctcgatctcctgaccttgtgatctgcccgcctcggcctcccaaagtgctgggattacaggtgtgagccactgtgcccggccgtcttttatttatttatttatttttgagacagagtctagctctgtcgcccaggctagggtgctgtggcatgatctcagctcactgcaaccttcgcctcctgggttcaagtgattctcctgcctcagcctcccaagtagctgggattacaggtgcctgccaccatgcccggctaatttttctatttttggtggagacagggtttcaccatgttggccaggctggtctcaaactcctgaccttgagtgatccgcccacctcggcctcccaaagtgctgggattacaggcgtgagccaccgccttctggggactttcttgatggtgggaaatggcagttaggtaagggaagaacagaccagacctcacttcccaagctgccttgctgtggcggcggagacctgcccactgagctggtatttttctagccttttccagagtgcattccatgtcttctcagcctgcacaaggtggttgttagataggcagaacaggcaggagcctcccattactgatgaggaccccaggccagagagctttggtgctgcctgagactgcacagcgagtccctagcaggcttgggcgggagctcgggcctcctgactgctgctctgcgtcccgtggggaccacactgttgtggaggcgcaccctgctctggtcgcctggtccctgcgctgcgcaccgtcattctctggctgcagggccagcgtgtggggctacttgctgctcacccgcccgtctctcttgcagggttacctgttcgggtgggcccatttccagaaaaacctttggctgctgggctacctcgtggtgctggtggtgtctctggtggactggaccgtgtccctgagtctcgtgtgtcatgaggtaggtggtgaggcagccctgagacagatggagagatctggggctggtgtgggtgcaaggcccacgggggtgctgggatggagccctgagcccgccagccatcctgcccacccgcccagcactgcccacctcccatggcacttccttcacttgttggctggggatccttgttcctgtctcacagatgaagacatggaggcctggacgggcacagggttcctcctggctcgccctgtttttgagggcggacctgggagtgagctccaagacttctgcctcccggctctccgctctctagctgaaggcctcggccgtccagccccggatgagagcgccacaccagggcctcaccatgccccgtagtcacaagccccaagctctgtgaggtctgacagtgagaaagccccctcacccggccacactcagccctttccaccgcagtgccttggtttcccctcagagcacccagaagcaccccctgggctttgggagaatagagctgggagaggtgggtgcggagtcagcagaatccactggggtctgtcgggaagcagagccccacaggtgccttgtggagagaatgaacagagggccttaaacaggctccgagaaaccaacagtgaaaggagcccagtggaacccagaaccaccgggagcagtcccactcatgggcaggggacgggggagagatgggggttgttagcacctggaggcccaagggaggggcccatagagctgggttcttgccctctgtcctctgggagggggtgctgtctggtgggcgctggtgcctcccagaagctcaatgaggttggtcccagcagtgccgatggggggctggaagctccaggtgcagctgataggaacagcctagtgagtgcatctcctgtccccgcctgccccagggccctgctggcaggacctggtggggagtagctgctgaggagagctggaatgggcggcatcgcagcccacagcacggcagagcggaggggtggctggagggcagccccgctgtgctgctgcggggcctccgtggccacctccttcctgtctccctgactcggcagcttcccgcagcctcctccctgcaaagggagagcctcttgcgtgactgccccagcaaagggagcgaggatagccctcccaccgccatttctgagttacggttgtggcagctgtatcatgttctgtaacttacaggctaaattgtaagccacaccaagaatccttatatgaaattaggatggggaaggagacaggaaaaagagacacaggtctacgttacaagcaaggaagaaaatgaataaaggcctggttttatacctggccgtgggccctgcctggatctcttctgccacctgctccgcgctcccttcgcctccgccagctccccacctggcccgggtttttcacctggcacagggactggaccttcctccctgaggggcccgagtccttggtggtcctgcctttggaaggctggagttttctgctaacttttcctatgggacataggagtaagaggtggcccagaggacccccacccagccctccctgctgttctcagtggcagcagccagcctgcccgctcaccctgctggcacagcagccctctttccatgaacaagctatggtccagcgtgtgtcccggtggaagcatccccaccttgggagtggatatttccagagcggggacccagaatgggggaggtgggaagtggaaagctgaccatccacctgtgcctcttcaccatgttcactcccattgcccttgcctgggtcccagtgggtcctggctgggggagagacagccccgccaagtggcctctggttcagagcctgtgctgtgccctgtgaccctaagctgacagcgttgctgagtcttcctaaggctctgggacccttcctacagccagctactgtgggcccgcgccggggctgccccagctctttcacctgaagcagcatttgcagggctgtgagtgggacacagtgccccacagttcattcccaggtcctgggatggtgctgggagaggcgttggaggcagggcaggcagattcataacctgcatgcctgtctgtccagggaggacagatgagcgatggttgtgggcaagggcccctctgttgtcagggggctgtctcgggctggtacctggccctgcctctggctgagtggttgtgctattggcaccaggcatagcctccgtgtctgtcgtggtggttgctttgtgtgtggtggagggagttaggagcagggtggctgagggaagaggcctagctgcatccacaggatgcctggtcctggccagagagcctcctctccacgatgcccatggtgggcgttcacatggggcaccagctccttaggccacgtgccctgcagaaaagctcgttcagagcagctggtccacatacttcctcccagacctcgtgcccagtcttccactcttctctctccacgcccctgtcctccacttgggaacatcccctttctcagtccacacaggggaccgcccaaccctgcccactgcagagctttcccttccgcagcatccgtgcagcgctttcttgatggaggctgaaatgtgcgtgtgtgtgtttccggctgggccggctatcattcagcacgtctgcaaaccaggcctgaggttttcctctgtggccagctgtccagtcataaagaactcctacaggcatggggtggcttgcagggaggactgggtgccctccagccttgtggccgagtgggttggataatatggaggctgccggtcactgttgggttttgctcgttcactcttgtctttgccagggctgtttggacgtggtttttcctcaaggccttgggtctgagggtcccaggggcttgactggcattgtggttggttgtccttggaggctagtcacctggatgtaccttcccgtccttatagaggcctcatggccccagctgtcaagggaaggccctcaggttgggctcttgtgtctggggaagctgtgctgtggtctgtgtctgactacaggtgagggtgcaagttcctgggcaggggaggggacccagcagcatcttcagcacctccttggcctgtagaggggctgaaagaagcctttgttatcaggccctaagaccagagtttccaaccagtgggcaatgaatgggttccgggtgagctgggcgcacagggcaggggccagagccctgagcagttctctgttcaccactgttctcttggccttctcagtcctgcgccaggccctggggtcccttttgagaatggtgattcacttggagtgagcgctggggatcagtcacttgcagatgttttggagggcctgccgtgctgctgctggctggaccttggtgaacagaataggcaggtctcttgtcctctgagacccccttctggagtgagagagagactgccagcgcacagaagtgccagacatagagtgtgattcccaagtgtggtggtgggtgccatgccggagaggagcccggcagccctggcagaggtggcgttctgcaggttgcgggggctgagccggccggctgggcagacactggcagcttgagggccgtggcctgtgaggtctgggaaggggctggactgactggctgggcctgttccgtggaccccggaggccatgggcagagctgtgggcagttgtcggagggttttggttttgtgcaaggagctgacagctctgcgtttctaaaacaagatactgatgaggatgcgagactgcagtggagagcatggatttgagattgacaggcgccaaagtgtaaacgagatactcaagggactgaatccaggtgtgaggcagagagaggaggtgggggcagggtgcccagcacaggcggatcgggcagtgcggggacctacagggcagctgggagcaccaaggtagctgtgtctggtgctgagggcgccaggcaggatgggaaggtgctcatggggacccccaggtgggtcccagtggccaggaggggaggatgggctgggataggagcaggggagtgaatggaggggagggcagggaaacgtggcatgatggaagctgtgagaacactggtgtgtgatggttggggcagaaggtggtgattgagccaatcctgagagggctggggtgggttgacaggactgtgggtggtgtggtggccgtgggtgggcccttctgtcctcacagaaggaaggcagggaagatggggatatctgtgagagtgtgtgtgtgtgagtgtgagtgtgtgtgtgagtctgttttgcgtgtccataaagcaagacctgaggctgggtattaatagagaaggggtttatttggctcacggctctgtaggctgcatgggaagcatggtgctggcgtctgcttctgatgaggcctcaggaagcatccactcatggcagaaggagacggggagcaggtgtgtcacatggcgagagaggcccccagactccttttaaaaaccagatctctcgtgaacccctcacctgaagtcattgctgcagggagggtaccaggctattcatgagggatccaccccacgacccaaacccctcctgctagatcccgcttccaacacggggagtcagattcaacgtgagatttggaggggacgcacattcacaccgtgtgagtgttgagcgtgggagcagtgaggctggagggcgctgtgtgagtgtgggggtgtggaggtggggctcctggaggcagggtctgtgtctgggaggggaaggcttggagatggggacacaaggggaggcgggttgaggggtgaggaggcggggatggtaccctgagaagccaggtgtgctgggcaaggcaggagggtaccaagggaggcatggggccaccacccttccagctgtgtcctgggtgggcacaggggaggatggcctgggacagggacaggtgttaggattggggaacctgtgtgtgcagcgcccaggagttgggagatgggtagtggggaggcctgtgacagggaaggactgcagagcatgtggcctggaacaggtctcaaggccagctctggagccaggccctccactttgggctcagtgactctggagtggcccccagggcactggggtctctgaaccgtgtgcccatctgggatggtcggtgaggggtagaactaagcacttgacgtggtcctcagtttcctgggtctcttccagcccctgcggatccgccggcttctccgtcccttcttcctgctgcagaactcctctatgatgaagaagaccttgaaatgcatccgctggtcgctgccggaaatggccaggtgggctcttggtgctctgggctcgcagggttgggaaggggctctctctgccccgggccacgtggttgcgggtggggcccaccggagtctcatcttggactgcgtgctccgcatccctggctggctggtgacggtgtggggaggctgctggggggcttttggggtctctgtggttccagcagttccccagaagcctcccagcagccttcgagntagggccagggctgcaaacaccgcggccccagctcgaaggctgctgagtcccatgggcactctctccgatgggtctcctcttgtcccctctgtggctgtgccctgcctctcccctctgccgtcccctcccactcatggtgtcggcacgctgccagcctagacttcataaagctgagctgctcctgacgacacccctgcttggaagccctcgtggctcttgttgccactagaagcgtggggctctctccctgcgccccaggcccagcctccatccagcctcggctcacccctggtcccgatcccctgccgccctccgctcttgccagtggcagcgttgcccgagtccctagtggctcacgtgctgacccctcaccatccagctcaggtggatggaagtggcctcccctctgagagccctgggtccttggatgctgtctcagctgggcccccagggtttcatttgtcactgtcaaagaaaggaccctgccagggcacgaccaggcctttcctctgggccccatgagctgagcatgaggcaaggccctcggggagagggggacccagctgctgcctggatccaccccagctgctgcagactcttgggcgctcctgtcaccgagccctgcaggcaggtcaggtgtccctgcctgcccgccgcctggcccaggctgagtgccgtgctctcccccagcgtcgggctgctgctggccatccacctgtgcctcttcaccatgttcggaatgctgctgttcgctggtgggaaggtagggcacccgtggtcagggtctgggaatggggctgccctgtgctgtgactaacacagggggctgggctggtgtctgctgccctggcctaacccatgtgcggactctgtccagtaatagcagtggcccatctggggtccaggagtctgcctttgggtggccacagtgctccaccaccccactgcccaaacacctgtctgccctggggtctcctgggctcaaggccacttgtcctttgtcctggctgtccgctcccaccctcctctgctccctcccatcctgactcagttcccctatcctccttcccacttccctcccccctccctatcccccgcccctccccgcccttccccgccaggctattcactgagggtgggtcctctggtttctcctccagccctgttcatccttcctgacaaccaggcttgccctgtaccctctctgactgcagcccccaaggctgcgctggcctattgggagggccctcacctcccacgccctctcctgccactagtctctcccaccatatcctcctctgcggctgccccggggcccagcagctcgttgctgtgtggaggcgtcttcctgtcccccaaccccgctccagtgctatgtgtttgtcctcctgtcctggccgagggcaccatccttcttggggctggggccacgctgcatctctgctgctttgttgtgggagtggacagtgctcagcctgcgctgctgttcctgtttgtggccgtgttggggtttggtgtgtgttgtccagaaggggaaggctgaagcccgcgttctcacccagggcggaagcggtcattgagcccctgtgtggctctgcatgtgtgtgtggagtctgcatgtctgtgtgcatgtttgtttgtatgtgtaggtgtatggtgtttatgtctgtgtgcgtgtttgtatgtgtgcatgtgtagtgtctgtgtgcatggtgtctgtatgtctgtgtgtgtgtttgtatgtgtgcatgtgtagtgtctgtgcatggtgtctgtgtgtctgtgtgcgtgtgtggtgtctgtgtgcatggtgtctgtatgtctgtgtgtgcgtgtggtgtcgtgtgtgtggtgtgtctgtgtgcatgcatggtgtctgtatgtctctgcgtgcgtggtgtctgtatggctgtgtgcgtgtgcatgtgtgtgcgtatctctgtgtgtatgtgtgtgtttgtgtgcctgtctgtgggtggtgggggcagctgggttgtggagatggaaccggctgacagaatctcaggccctcctctgtgtgaccgtccagtgacccctgcagtagcgctgtttgccagagcctgtaccaggtggatggcgtcagtgtgggtgctggaagtggcaacagcctcggccttgaggccagggtgtggtcctcggccccgggaaagccaagtgtcccatcctgaggcacctggaagggttggctcctcctccaggcgtgggtttctgccccacgaaggggacctaggggagcaaggtgtaccttgtgtgaggggtgcgtgcttgtcgtggtcttggcaggagtctggatccctgtccgaggcaggacttgagaggagcgtgggatggtacccggcccatcctgccttccttccctggccatcatgccctgccagcctggcctggggcggtagccaggctgtgcttctgggtgcagcggccgccttgctttagctacctttgtgagtgcggtccagagccagcctgcttgtcctctgctggctttgctcgttgtgaagctccaacctggattgatttccaagaaccagggttggtgttggggtgtgtggtctcccagcagccgtgatggtgctgtcccattttacagatgtttctcaggtcggggctgtgggctggctcgggtccatcgtcgctggttgtggcaggttgggcaggagcccagggctcctctgtgtccctgcagagctgtggcttgggctgggcaggaggtacgggaagtcatgcctagggtctggagctgaattgtagaggaggagcgtgaggcctgctgggaggtacacagtgtggggtgggagatgggccggggcagggccacctgccttggggagttctgtcggctctatggacctcagcgtctgttaggtggtgtgcctcagctggctcgaagcctggccctaaaccttgctccatgggcgctcggtgggttgctttacatttgggaacgtggtggtttgactgggtgagggtgggacgggggatgcccgggaggcctggacccagtgctgtggtcctgccgtccccggtgaccgctggaggccagcctgccctccaggcctcggaaggccttgctctgctcctccactctggcttgggctgaggcccaggaggggcccgcctagctctccccagcaggggagcctgtccctacccgtggctctgtgcctgacagcgctccctgccttctgacttcctctcagtggcccctgtgccccctcccccagcagactgtggagtcttcaccaattagctcacgtgtccttgggagcccctgactggacagacgaggggacagtgccattttataggtgaggccttggaggcctcagtgctattgatgcggctgtgaggcaggaagggcggcctgtgcgacagagagtggccatcacaggtgcctccatgccagggcctgcctgcggggttgccccttggccagcagctgggattgtggctttgaaacgatccctaagagaggaggttgctttgtgtgccaagtcccgctgtgccacctgcccccacagttcatacaaccagtctggtttgcgggaaccacccatcttccagctggggggtctggaggcttggtaggcagagggtgcccatgagcctggccccagtgagagccccgggcccggagtctcaagcagagttgctttccgagcagaaacactgcatgtaccagctgtgttttgtggctgggacccctctcaggagggagagaggatagggactccggtgtggatgcccccttaccaatggctgtgattcgccacagccacgagcacagtgccactgagtcccgtgggtggctatgggcggccgtgggccctgacacacagcctctagagcaggcttcacgaagggtccaacctatctcaccctggcagcctgggcccctctgctcctcctgcccctcctgcctctgccccgtagcctcactgcttgcacagtgcatggcagagtcggctgcgagcaggcgaggtggcctgagggaggtcactaggctggctgagggctttttgctgtggttctgagccggcctgcttccaggcaccgtgtccatgcgggtgagcggtctccctgggtgcccactcttgcgcccggagatcctgagtttggtcctgtctggccatgaactcagcctgctgggaggccacagggagatgcaggctgggcggcgggtggatggttccagccggttgggtccggggcctggagctcagcctgtggggtggggacccagtggtgccctggagctgccgcttctgctctcagcaggatgatgggcaggacagggagaggctgacctacttccagaacctgcctgagtctctgacttccctcctggtgctgctgaccacggccaacaaccccgatggtgcgtgcagggccagggagggaccgtgggggtcggtgagcccagcactggggggccggtttgggctgctgagccttagaacccagtgggagtttctgaggcctttttttcgataagtggagaagaaagggtgacattttccttcctccccttcttttcctatctcttctttttttgtcttggttttcttctccctctctcttgtcccttctctttccttctttccttttctgtctcattcctttgctttctcactccctcctccctttttcttttcatctcctcttcctccttgtcttctcactcctctgagaagctgaaagtggctggtgttcttcatagggcgatgatggcagtggtcagaggggtctcctggtgccgtcctgctggagctccacacatccacgctgcggttgctgccgaggttcagctgtgggagccactgggcagcagcatgtgagggccaagggtcttactggccacgacgctcaccctgtgtgatgctcatggggcctccactgctcaggtgcaggtgtggccaggatggaggccacggtcctgggcttggctgtggcccagccaccctggctggtgcctttcatcttgcggaccctgagtgctgtctcttgtgtcctctgagtcctaggaagtgaccgcagtgggagcaggaccgtctgagtcctaggaagtgaccgcactgggagcagggccgtctgagtcctaggaagtgaccgcactgggagcaggaccgtctgagtcctaggaagtgaccgcagtgggagcaggaccgtctgagtcctaggaagtgaccgcactgggagcaggaccgtctgagtcctaggaagtgaccgcagtgggagcaggaccgtctgagtcctaggaagtgaccgcactgggagcaggaccgtctgagtcctaggaagtgaccgcagtgggagcagggccgtctgagtcctaggaagtgaccgcagtgggagcaggaccgtctgagtcctaggaagtgaccgcagtgggagcaggaccgtctgagtcctaggaagtgaccgcactgggagcaggaccgtctgagtcctaggaagtgaccgcagtgggagcaggaccgtctgagtcctaggaagtgaccacagggggagcaggaccgtctgagtcctaggaagtgaccgcagtgggagcaggaccatctgagtcctaggaagtgaccgcagtgggagcaggaccgtctgagtcctaggaagtgaccgcactgggagcaggaccgtctgagtcttaggaagtgaccgcactgggagcaggaccgtctgagtcctaggaagttaccgcagtgggagcaggaccgtctgagtcctaggaagtgaccgcagtgggagcaggactgtctgagtcctaggaagtgaccgcagtgggagcaggactgtctgagtcctaggaagtgaccacagggggagcaggactatctgagtcctaggaagtgaccgcagtgggagcaggactgtctgagtcctaggaagtgaccgcagtgggagcaggactgtctgagtcctagcaagtgacacagggggagcaggaccgtctgagtcctaggaagtgaccgcagtgggagcaggaccgtctgagtcctaggaagtgaccgcactgggagcaggaccgtctgagtcctaggaagtgaccgcagtgggagcaggaccgtctgagtcctaggaagttaccgcagtgggagcagggccgtctgagtcctaggaagtgaccgcagtgggagcaggaccgtctgagtcctaggaagtgaccgcagtgggagcaggaccgtctgagtcctaggaagtgaccgcactgggagcaggaccgtctgagtcctaggaagttaccgcagtgggagcaggaccgtctgagtcctaggaagtgaccgcagtgggagcaggaccgtctgagtcctaggaagtgaccgcactgggagcaggaccgtctgagtcctaggaagtgaccgcagtgggagcaggaccgtctgagtcctaggaagtgaccgcagtgggagcaggaccgtctgagtcctaggaagtgaccgcagtgggagcaggaccgtctgagtcctaggaagtgaccgcagtgggagcaggaccgtctgagtcctagcaagtgacacagggggagcaggaccgtctgagtcttaggaagtgaccgcaatgggagcaggaccgtctgagtcctaggaagtgaccgcactgggagcaggaccgtctgagtcctaggaagtgaccgcagtgggagcaggaccgtctgagtcctaggaagtgaccgcagtgggagcaggaccgtctgagtcctaggaagtgaccgcagtgggagcaggaccgtctgagtcctaggaagtgaccgcactgggagcaggaccgtctgagtcctaggaagtgaccgcagtgggagcaggactgtctgagtcctaggaagtgactgcagggggagcaggactgactgtggggagggctgcagggaggctttcagctctgtgtgcagagggacatccttgataggtagggagttccccgtcctggagggtgtgcgagcagaggcaagagatcgaatttggacaggaaggcctttcagccctcccaggagacctcctttcttttttttccttttctttctttttttctttctttcttttttttttttgtttgagatggtgccatgctctgtcacccagactggagtgcagtggtgcagtctcggttcactgcaacctccacctcccaggttcaagtgattctcctgcctcagcctcccgagtagctgggtttacaggcatgagccaccacacctggctaatttttgtatttttagtagagatggagttttactatgttggccaggctggtctcggaattcctgacctcaagtgatccacccgcctcagcctcccaaagtgctgggattacaggcgtgagccaccacgctcagcagtggagacctcctttctattgcaaaagcaaatagtgtagcgtcaggatgggagtgggatcaggtactgaggttgtcagtttctgttatttcttttttcttttagtgatgattcctgcgtattccaagaaccgggcctatgccatcttcttcatagtcttcactgtgataggtgagtgcaggtaacgtggccagcattttgtgacaggatcccgagagctcagggaccgatacactctgctgcctccacgacctgaaacttcacatccgtgtttttcactccagagatcaccccagggatcccctgccaacagcttttaaccccagagatcccccaccaacagcttcacccgagggatcccccaccccacggcttcaccccagggatctcccgccaacaggttcaccccagggatcccccaccaacagcttcaccccagagatcccccaccaacagcttcacccgagggatcccccaccaacagcttcaccccagggatctcccaccagcagcttcaccccagggatccctcaccaacagcttcaccccagggatcccccaccaacagcttcaccccagggatccctcaccaacagcttcaccccagggatcccccaccccacggcttcaccccagggatcccccgccaacaggttcaccccagggatcccccaccaagagcttcaccccggggatcccccaccaacagcttcaccccagggatcccccaccaacagcttcaccccagggatcccccatgccacggcttcaccccagggatcccccaccaacagcttcaccccagggatcccccaccaacagcttcaccccagggatcccccaccccacactttctgttctgtccccaccattgacctcgtcatcctcccacctgtgactgcgctggccaggccatgtttccatttgataggggacgcccccggcgctgtgctatcctgtgccggccacccttgcgttggttttgctgctgtactggtggcgcccctgaccgtggctgtctcctcttgaaggaagcctgtttctgatgaacctgctgacagccatcatctacagtcagttccggggctacctgatggtgagcgagctccccaatgctggctgtgcctggagctgccgggaggccaagcagggtgtggcttgagatgagcagctgggtgacccttgctggccaggcccctggtgggacgggagggcagggttgccacctcttgtggatcagccggggatgcacatgtgttgttgctctagccactgccagagatggcaactcccaggacagcagaccctaaaccctcttgagggggagctgggggcgcccccaacacacagaggagaaacgcggcccagcatattgcgcagcacgcccgtcagactccttcctgtgcggcctgtcccgggagtctgaccaatcctctcattcctggggggtgaggggctgcccccaggctgtggggaactgggcccccccccaaggctgcccagactccccctctgcctgttccccaggggagggaagggtcgggggttctgagctgggggagggctgatcctgccgttcatagccttcctctttgcagaaatctctccagacctcgctgtttcggaggcggctgggaacccgggctgcctttgaagtcctatcctccatggtgggggagggaggagccttccctcaggcgtgagtgctgggcatggaccctcttctccctgagggtgggtgctgtggctgctgggcaggggccgggtgttcattaggggcttcttgtgcttggcctgtgcctcgcccctgctggctggcacccgactcatggaaaccaccatgtccctggcgctctgtggttcccggcgtccttgtcctgagtccatgcctttgtcttcgtgccccccggggaccctgggctggtgaagggccgagtggcccggccttcttgtccccctttgtgctcttctacccttctgtgctgacttaggcagcagagccagaggtgcgtgggccaggtgtccacaccaccatcctgcttggaaatgagggcagagagcttgagggacattgcagtggaaagttctggtcctgactgctcatagtggtgaagtcagtttgcgccttctcggggggacggcagtggcaggatgcttgttacaggggctcttggtgtggctcaagctgcaaagtggcttcatggcaaagctcaagccagacgccagggcaggaggacccaggccagggttccaagggagccgagctggctgtgctcaccgggctgtgggtttttccctgcagagttggggtgaagccccagaacttgctgcaggtgcttcagaaggtccagctggacagctcccacagacaggccatgatggaggtacccgccccctgctcccagcctcctctgggctcctcccgggaggtcacttgggccagcagccccttttcaggactaggggtgtggcttcaggtcacctgcagcattcacagcccgtcagggtggggttggggctgggggcgctcaccttcgagggcgctcaccttcccgtgcgcccctgctgacctgtgctccttcctgtgcagaaggtgcgttcctatggcagtgttctgctctcagctgaggagtttcagaagctcttcaacgagcttgacagaagtgtggttaaagaggtaactggggccacagccgcccagggtggatagtgggggccttccagtttcccctgcccttgatcacctggggaactcttctaatgatcagtgctgggattcacctgccagggatcctggctcctagtatgggaactgggaatggagttctctttggctcttggagactggggagatttttatgaaattcaccagaccccaggaactagcctgagcccagcccgacatgaaggagtcttccaaatggtcttctcggtttccatgacagactctccttttcctgtctgtccttcctcaggaggtccacacactggtcctctccaaggcctttgcctttcacccttgacacttacaaagttcccaggtgggcctcagcatccgactaagctctgtgtccagaaggcctgggccaggtgggtggagacagtgggaaacagcccaggtgcccacaggcagtgtgggggcagcacgggggctgccattccagctgctcagcctcagaggactgagccagaccctggaacagggatggggcagagaggtggggtggcagacgcctgccagttctgtgtcacttttctcgtttgctcaggctcctgggacggcaccacagactggggcgggggcagggctgaagcagcagacatttgttatctcacagtcctggccgtcagtccaaggccaagtgtcacagggctggttcctcctgaggcccctctcagtggcttgtaggtgctgttctttccccatgtcctcacctgaggcctctctccgtggcctgtagatgccagcctctccctgtgtcctcacctgaggcctctctccgtggcttgtagatgccagcctctccctgtgtcctcacctgaggcctctctccatggctgtagacatcgccttctccctgtatcctcacgtggtcatccctctgtgtgtcatctcctcctcttataaggaccctattcagattggattagggcccattctaatggccttgttttaactaaattaccttttaaaaggccctgtctccaaatatagtcacattctgagctactgggggttagaggttaaagatacgaatttcgagggagacaaaattcagcccatagcaactgtcagctgcttcaggattccttgtcggcccctgtggctgcaggaccctgtcagaggtggttctctaaaaaacattgttttcctaaggtccttccagacctctggagtcaggccctgccccagcctgagcttgagtgccacgcactcgtccccatcctcacttcgggcatcctctttagggctgcattcctcattgtggcacccccagccccttggggcatatgggcgatgagtgtggtgaggatcagtaggtggcagtttgaatattcacgccatcaaacctctgtttgggacaaggctgggcaatgcgttatcaacttaaggttgacttgaagatacgaaataaattttaccaggtgcagatttcacagaaactgtggagatggtcctcagataacagaaagttaagaggcaccattctagataaaggcgcttgtcctaggggcggagctgtttggggctcaggaagcagctcttagcggctgtcgtaggctaggtttgctgtgatccggcccatgtttaacccagacggacaccttggccaagagagatttcagcattatctattatgtctaaattgttacaaggagaaggtgttcgtatgttagctgtgtaactgagagataactgatatgactaaaggggcaggcagacacaggctgggagaagccagtcatcctaaaggttctggaaaggtggtttttgttcctcaggctttgctcctggtgtgttctgggccatctgggctctccctgggcagttgttgccgttccctagggcgtggttgagtcctggttgtccagagctgactctcccacccttttccagtgtcaggatttggtgagacctggaaaggggttcctcctcccgtgatgatgtggaggaagggcggatggattgctttggccgtgacccagtagagcgggcttgtgtgcgcacaggagtggggaaggcccaacacgcaggcctggcctgattcccagcctggtggtctccctggaggtcccggcgatgctcttcccagggcaccgagcactgggctttgagatgggagtttaggttccacaggttttgggagccacaatagccttaatctggttttctgactccttctttcctcaataatgctgactgtagaggggaggccgttgcccctcggtatctgcagggattggttctaggactccatgtggatacaaaatccatggatgtttaagtctcttaagatgatgtagtgtttgcatgtaacctacacacatccttccgtatactttaagtcatttctagactacttggaatacctagcacctaggaatgcggtgggagtttggggaataagggtaagaaaacctgtacatgctccgtacagatgctttttccctgagtatgttttgatctgcagttggttcagtctgcggacgcagagcccgctgacgtgaagggctggcagagcttcagtttgggaggcagatgcttctgggattgctcagatttggggcagcctgtggttttggaagcacaaagaggtcctttctcggcaggctgacgtcatgggagctccagccttttcgagagccctcccgtgtggggtcactgcctgggcgtcagcctggccgtggccagggagtcggttggtgcttgctggcgaacttcaaaaaaggtgccctgcctgctgctgaaagaagtctcctcttcatatgagaagcttttggggttaaaaatgtagtggtcattcattatagacaacagagggaagtgggaaaatccacctcacgggctttctacccagagacaagcactttagtcatatcagttatctctcagttacacagctaacatatgaacaccttctccttgtaacaatttagacgtaatagataatgctgaaatctctcttggccaaggtgtccgtctgggttaaacagaaagtgtcatgtacggcagtggcaactacgataaaagagtaactgcaagatgtaaggaaaccatgtggtgtccttgggctgaggggagtgcatgaggaaggatggacctggaaggggaccctccgaagctggggttcagacctcttgagagcaggtgtggttttgcccacaggaatgcagagacgttcactggcttccccgggctgcggttggtttgtggtcactgggtaagcaggaggcgaccctcctgggtgcagcaggcccaggctgtgagcaggcagtggcgtggtcctgccgagggaattcggtgccagtgtgggcaggtggcctttgggcactggtttccacattgaggactgtgggaagctgggaaattttcaggaggtcaggctgtggctgtaggtcgcctggggactatgtgtcttggacagagcgtgtccagatgtgcttaacaccacactccgatccaccccgtagcatccggaaaccgcaggggaggcctgccctcctgctctgtccctccacctgccctcctcctctgtccctccacctgccctcctgccgtgtccctccacctgccctccctgcggtgtccctccacctgccctcctgccgtgtccctccacctgccctcctgccgtgtccctccacctgccctcctgccgtgtccctccacctggcctccctgccgtgtccgtttgacggaagccgccagcaaggatagtcacctcccacctcc

SEQ ID NO: 27 - DNA, 33485 bp, Homo sapiens
ttacgcattgcttggattcttccggccgccgtggctgaagacaaaggtctcagtcagggaccccactggctgtgtcccccagtcgtagcctcagagacagagaaccccaccaggccaacctcttggccccatgttttccagcactgtgcactgctcacacagttctctcctagaacacttgcacttccagaagccctctctcccaaggatcccaacctcttcctccaagtagacgctggggcactgcatctgccaacttctctctcttccatgccaggacacactgaactcagcctcacacaggcctgaggtctgtgccagagttggccacttcctagctgatgaccctgaagccacagactttcctctctgagcctcggtttcctcatctgtataaagggcctcataagggaaagtaggaaggattaaatttgataatgtgtgccagatgccagtgctgtgactgatacaggagatgattaacaaagtaacatgaggattgatgtattgattgatttatcaattgattgatttgcaactctgaagggagcaagtgttcttcaaggcagccaggtgggagatgcctaaaggcagagcatggcaaacggtggtgctgccctgtcttgatcttggtcaacacctcagctatctcccacctcagagcgagcaagaaaatggccacatctcccagctcttgatctaaagagtttgcagtgcctgattaaagtgatcagttgtctcccttgcagactcaaaaatgcctggagccacccctgcagatcctcacttctcacttctccactgcacagctcaaaggccatggacatcccagccatcaggactcagggcgagccttaacagagtacattggatctcatccttcctccactcaaaccgccaggagctcctctgctccacacaaggccccttcagggaacctcgaggagctcagcatgccccacctcagggccttggcatgtgctgctctgtcctgaggtctccactgggatccctgcctccctttccttggatgtgtgttccttcatcagccaggcctgccctggcccaggctaaatctccactggagctcaccactgcctgatgcaccagacacttggtctgcttctcctggccactctgactagaagagcccaccaaggcaggcacttgggtctgtcttgttcacagccatatccccagcccctggcacccagcagcattcaataaatggtaattgagtggataaatgaatgaatgaggaggtacctgttcattcatttaatgctaatactaatactgattaacaataataatagcaggagccggctcttcacagatgctgggattcaaaggtaaaccagacatagttcgcattttcaatagtcaacaaatgtgtaattagccaataaataagttaataagtgatcaataaatgcatgatcatagactgtggtggggctcccaaaggggcaggggcaggtgcttggatgggcaccaaggagctcctcccccagggagtgggtctgagacctgaaaggcgtgtgagaatgagaaaagcgtgtcggcagaacaaatgtgtacaagtctcctgcagctgctgtaacaaaccatcccaaactgggtggctcagaacaacacagacttattttctcagttctggggacccgaagcccaagacccaggtgtcagcaaggccgccctccctctgaaagtgctagaggagggtccttcctgacacttccagctcctgggggctccaggtgttccttgactgtggccacatcactccagtctctgcctctgtcttcgtgcatcctcctcctcctctccgtgtcttcacctcttctctcatgagacacctggcattggattttgagcccacacagataatccaggatgatctcatcccttaccttaatttcacctgcaaagacccttctttccaaaaaggtcacacccacaggttctaggttaggatttggacatacgttaagggggtcatcattcagcccaatccaaacatcctggacaaaggccctgaggctgggaggtgtagtgctggccagtgacatggcaggggtggcaggctcacagtgggcaggggctcgtgcacgcaggctggggaccagggtggagggctgtggacggccatggctgagtttcacaacggggagggacatgatccaatagctgctgcgggtgcaaagacagagcagagaagtcagcagtggagaaacaggtggaccatcagggaccactatagtcctccaggtgtgttggatggcggggctgggacaggggagagggaatgaggagaggcagaccaaaaatgtgcttggaggttcaaatggactttgttgatgactgcaatggggtggggtgggagcatcaacaccgagcccaggacacgggcatgagcaggtgggtcacagaggcttctcccaagatgaggaggagggtgtgaccaggtgtgatactctggacaatcctgaggtgtgatactctggacaaccctggggtgtgggggccccatctcacagagctgggataagaggaggctgaagcaacattcaggtggggctgtgcctgcattcactgtggcatccaaggcagtatggtagtcagcaaaccctggtgctcagcaaacccaggtgcttagcaaaccccactgctgagaaaatcctggtgctcagcaaaacccaggtgcttagcaaaccccactgcttagaaaatcctggtgctcagcaaaccctggtgctcagcaaaccccagtgctcagcaaaccctggtgcttagcaaaacccaggtgcttagcaaaccccactgctcagaaaatcctggtgctcagcaaaccctcacagcatagtccctggatggcagagcctttctcagtgtttctggcatgaatactgcattccaggccatggggtttgcactgtgagagacccgtggacctgccccaggtaagctcttagtgcagcagccactggtcctctcccagcagcacgggctgggccactcctgccatgccaggtttcagcctccccaacaccaggggacctgatgctaagttctccacaggcccttcccactttaaagttctccagctcccaaaaaatcagggactttccaatttagaaaataccctcactggatggccctacccatccagccattagcttctcaagcaggccaggcagtccctgggctgcccacctctccgcaggcatcagccccagcaccacctcttggatatggagcagacacagcattgcccactgccctgggccctccttactccttctctgtctggaccagttcttcctcttccctccccacatcctgttgcaaccattcatgctcagggatcctcctctccccagaagctgtggcctctgaaaaccccaaacgctgccatttgctgtcccacctgcctttctgtggctgggcccccacacagccagatacagatgctgtcccctgccctggtcactcagcaggtgagggctgggccctgggagcctggcctctgggtagccctgagtgggaagatggtggagggaggcctgtccccactggagcagttcaccaaggacaggaggctgggacaagctccctccgtcccctgcccacgggctcagagaatcacccagaggcaccttcccacagcgcctcactgggcagccgggcctgggagccagggccagcaggcctcaggggacctggaaagtttggttttgctttgtggatctggacaaactggaaatgtaaagggctgcactggacgtacccagctgggcaaactggaagtgcttcaaagagctgggggcagggccgggcggccggttcacacggctacggccaagctcagcccatcactcaggccacctgccggagcccatgcaccacctcgctgctgcccctccccactgccagtggtcatggaccctgcccacagagcccctcggcagcagggagctccgggccagccaagcgcaggcctcctcctccatgatattaatcaatcacatcctgatagtgatcaatggagggcccctggcagcaatgggctggccagcctccaggctcaccgtccagaggcaggaacgccgaggatggcaaatgtgatctttggcaagggacagcacattgtcttaccgctgtgggaaaatgcttaatgcgcaaacatttccttaaaacgagctgacaaggaaacgttcaagatggccttattaaagataatcatcctggctgaacaggacaaaaatagattaagtcccttctgaactctgagagcaggatacgtggcccagcagagcatcactaaaccaaggcgggtggcagcggggaaagactccacggctttcccttgggtttcaccacttggagaagcttcccagtcggctggcgtggaagcccagctcctcaccccaccccaagcacagggcaggcgctgagccccgggctggcagaggtagggagtgggctgcaggcacggggcggggagggggcctccggagctgcacacaggaatgtcagggcctggcttaatttctaaacctgccatatggccctgcgtcctgggacccaggctggtggccaaggaggagccctggggctcggtccacagccctccaggccggctgcacaaagccatttttcaaaggtgtttcccaacagtctctctcaaaggaactgccctttgagaagctgtcttgggctcgagccaggcagggctgtctgggggctcttggcaaacgtgccagccgtccccagatcaaaagtgcctttcttggtttgctcactgcctctctgtgccaggtgaatgagctgtgggggcaccccgggccgggcaaggccagagttgtcttacccagactcaaagatgggggtgggggctgaccacaggtgcggtgtgccccaccaatccatggaaaccccaacccacggggcaatggctcacgttacaaaagatccatggaggggccccttcaaaccgaagctccccaaggacgtggcactgttgctcagggatcattcgccatgtgacacagagaggcccagaccaaggaaatgtaaggccagagggctcacaggccctgccagctgacgtggcctcagtctagacagagagacaggcaaagtgggcacgacgggggtctgtgaaaccaacccaaccttcattcacccaccacgggaccctcccttctgggcagagacaggtgctttcgacccagcaggtgggcgctgacagctccactgccacacaagcccctggcatcttctcgctgcagacacacttggtggcaagtgcttgcgtgtggacgctgcgtggcccgatgtcccatcggtcagtgtccaagaggaaggctctgggatgccgcttactcagagagccctgcacgcaccactcccagcttcacctgtgctgccaggctgggaccaagtccaccttggagatgtggctggcaactgtcatcgctaccaggtccatctcgccgccactcactccccaccgccctccaataatgccaacaaaactcacagtggagccagggtctcgggggaaagaagaaagatctgcaagagcctccccgaccatctccagatgcctgagccccagagctgacttgcacggaggctgatctgcatcgaaggctggccccgggccaggcacctgggagggctttgggcccatctcccacctgtcctcgccttaagccaacagggcaggaactgtggttattcccgttctgcagatgaggcacccaaggcacaaggagtctgtgcagccagcgggtggaggagaagctggggccacccccggaacatttctgaggacaccattcctggccctgtacaaaccgactctgtcgtctccattcgctacagagaaccagcaactgatgccagtgcagtgcagagaaataacgggcccattttacagatgtggaaactaaagttcaggcaggtccaataatttgcccaaacaccaaacagctgcaaatgggaaggctgggatcagaaggaagactggatgctagagcctccctggcccccatcccttcattcctgatacctgcaccccactctctggccttcacccctcccaatgcctagcatgcggccattcaaagcaatgctgggttccgcccctcaccgtaaaaatcaaaaagctgcctgctcgtgaatgcttgtgagagagaaaacacctggaaaggtagaatcaggtgctcctaaaattcacatccacttggaatctcagatgtgactttacttggaaatagggtttctgcagatgtaataagttgaggttatactggagcagggaaggccctgaatccaatacaatcggtgtccttataagtagagagaaacgtggacacagacacacaggggagaagacacatgaagtgggagacagagactggaacgatgcagccacaagccaaggaacaccagagccgcaaaaagccaggagcagcaaggagggacgcttccctagggccttcagagggtgcccagtcctgctggcacctgcacctgggacttctggcctccagaactgcaacacagcacatctccatggtctaaagccactcaggctgtggtactttgcacagcagccccagaaaatcagcacagcacccagcaccctgcatctgggggtcagctcccacctgttcctaccacattattggccaactgaggatgggagttgaattttgttctggaacaaataataataataaatgccagaactcgccacccctgtgctcgggtccccacagcctggaagtgtggcctctctggaaagcattccttcttgccccagccaagtgggtggcccctctgtaacctctaccagattcacttttcccccatgtctcccgtccagcccggagtccgcctcccggggccactgcccccatgcaggatggagcagagctcgccatcctgcctgccccatggtcatgtggagtcgctgcctttcagttatacggcaggactacttgccaggtggaaagtgggaccatcggccctggcgcccccaacacattcttggcaactgaaacaaatgccagaggtagatgagccaggcaagactgcctcccagagggggcacactgccgggcctgcgaacccttcatcaaaccccaaggagccggtgaacgtttgatgagggtcctggggtctcaggcccttctgcctgggccagtctcatgtcccgctcgagtgacgtgggtcagcagtttccctccagcccagccatggccatcattgcccacctgccacctctcaagggagcagggcccccactcctccttcccagctctactgagaggtctccttgcctccagccacagagcccctgatgcaccccttcctcctggccagagcacaggctgtgcaccgcctgtccccacgtctgagctaataccgccacctttgggcactcagactgaggcaatatcccccacccgtgttctcctgtcttcactgggtgacttctaacctcagacagtccccaaaacaaatgcaatcccttttgcctgtcagagtggccaacaccaccctggtttctggaggcagccagcccaggtgtactcaggggcaggcgtgttccaggatgttctgagccccagctccctcctctgtaagtcagaagtgaggatgcatgagtatgcacagcacacttccacacagtgttcccgctgtggccaccgacggaggtccagggtcccccaggctctgctctgatgctggcccagcacccagagttttccttgaccatttttccagggctgtgccagaggctgggtgggctatgccaaggagaaaaagcagggagggggcgtgggcggagctgatggacaggcagggcacccggggcccaagccgctgctgcactcaaggaacagacattggggtgacctcagcaattgcctggatgtctgggcctcagtttcccctctcagtcctccctgccctgtccacttccaggagaaggggctgtgcagtgcggggggaaaggtggagctgtccaacttggcctctgacagctcccaacctatttccccttctgggactttggccctgtctgcaaagcgtgacccccctcaccagtggcccactgcatccccagacacagagcctcttttctttgccccagtgaaggctgaaaatggcctttccctaagcgcactcaccagcaaggggtgactgcaagagcctcctggagacccggatttctggggaaatgaggtggaatgagtcgcatacccacagaagcgcagggtcttttgagcacctcacatgcctgggggcactgacgtggcccacccggggagaagggagtctgagtgtccccacagtggctggcaggtggacagacccaggggatgctccagccccacccagcgggaaccccacagccagagagggccccatcagtaccctgcactccaggtggccggctggcctggtggtgggagccagcagcccacctcatcacaccctctccccactaaaagcacgctaccctctctcctggctagaatctaacaagtgttggttgtcactgccaccacacagattcccctagggtctcttaggcaagggttgtaaggttcccagcacaggcccaggaaggctgccaggaggaggaggagctcctgccaggaggggactccccctgccttcccaggcctggtgctgagcgaggcaaggagggtaccagggcctgggcactgggtcgcctgccgctaggctctgctgccctccgctggcctacccaggaactgcgtgtgcccagggcagcatctccaggtgtgtctagcctgcctaccttctctacctggccatgcctctggacatgcagggcctctgtcgcaggccctcacctgtatgcaaattatgctctgagggcatcttgtaggttacaagcctccggtacccaggcccagctgggacgggctcagtcatgcctgccctcatctgctaggtctacgatgctccttccctggtgcacactgggggtggcgatcgctattcaacaccatctggggcttcttcaaaaggtgatgacgtcacccctgagacaaggtgggcattgggacccagcaccgatgtgggacccagaggtaggaggctcgcagccctgccaggagccccctctgctcacttccacctcatctcacacaccaggaacctgaggccagtggagaaggggccacagtgcctgtgcccacagagctgggctcatatccaagactgtgtcccctccaagcccagctcatcactctctgccctgccagtgattgacaaaccagtggaccagccagcaggcctcctctgaggtctcccagactgcctgctcctggagcaatacccaaggtgactgatgccccatgcggctggagcactccccacttgggcaggcagctttgcaccagcaccaccccaccatgcctgtcccatggaccccccaaccctgggcccagggcaggttgttcccagatgccgcagccccttgagaggtcacagggcatccctctgcccaggtggtacccccagcccaggctcgggcagcattcgaggccaccgctccaaacaaaactgagagagaggggccctggggacagccccaagctgcaagctctccacaggctcccggaacccaggggctcaggcctagatgtgttccagaagcacccctgggccgctgcatggagaaacagcagggcgcagaagcatgaaatcgttgcacttgccccatgtggccttggctgcctggaggtcgcgatgtgaggtcttgcagagcttggcaccgggaagtggctgctaatgagcacaattcgggggctgcactgttctcctgtctgccacaacaaatcaccaccaacccggagctcagaacagcagaggtttcttctcccacagttccgggggtcagaaatcagggcattggcagggctgtgctcccaccgagggctctagaggagggtccttcctgcctcttccagccccggagggctcccagccttccctggattgtggccgcatcactccagtctctgccctctgtcttcacgtggtcttttctgtggtctctgccttctctattcttataaggcaccagccattctattcagggcaaccctaaatcctgcatggcctcacctcaaggtgtttaacctaattacacctgcaaagaccctattacccaaataaggtcgcatttgaggtgccaggggttaggacctggtcatactttgggggatccccgctcagcccactacagtgatgctaatgctgggatgtggttctcattgtgtgacccccggccggcagcatcagcaacaccagggagctggtcaggagcggaattcccaggtccctcccaggcctgacaaattggaaccctggtgcggggctggcagcctgttccacgagccctccaggaatcccgatggacacgaatgtttgggaatcactggaacaatgctggaaagctcccccaccaccccgctttccatatgtattggagagtctgttttgggtggatcgggtgccatgctacgggctcatttattgggaccgacggcatctgggacattccatccaggagcactcacaggcccacagccagctgtgagacaggagggagaggtcgatgttgggacagacagaacaggtggtaggagctgagagggggttgttctgatgggggagatcaggaaagccctcctggggagggggctgggccgaccccatcccctccctgccacggctaagccactaaactacaccagagctgaggtacagctgagcttaaaatcagagctaagctaccgctgacattacactcataaaagacaggcaggagccctgcatggaccaacagaaggcgcggccgtcccgggcctgggaacttcctggcactccctccaatgtgagcatgccacagaccacagtcgtgttcatgaggcctctgccccatcaggagcagaagtcacaggtgccttcaaatcacgcggtcgccacagccggcatctccacgcgtccttcctgctcagcgccacgctgcagctgcacaggccttactctgtcacaccttggggtttgggatattctgttaactgctgctcgatgtaattattttccttgtggctccgtggatttggggctgatttaaagacattatttgaggctgggcgcagtggtgtggcactttgggaggctgagacagccagatcctttgaggccaggagttcaagaccagcctggccaacatagtgaaactccatctctactaaaaatacaaaaaaaaattagtcaggcgtggtggtgcacacctgaaatcccagctactcaggaggctgaggcaggagaattgcttgatcccaggaggcagaggctgcagtgagccaagatcgcgccattgcactccagcctgggtgacaagagcgaaactccatctcaaaataaataaataaatagaataaaataaagacattattcgaagaaagggccacggattcagtacatgcctagaggccctgacacccaactggctacaaaccttgactcccaccctctggccaatccagaacttcctggtattttaaagtagcttgtaactatttgtttcaccatcaggataagatgtgtgtgttcgttcgtgactttaaacatcttatttttcctcatagttcttaaagttcagcctggaatggtttaaaatactaaaagggggccaggtgcggtggctcacgcctgcaatcccagcactgtgggaggacgaggtgggcggatcacttaaggtcaggagttcaagcctgacccagcctggccaacatggtgaaacccaatctctacaaaaatctaaaattacccgggcatgatagtgggtgcctgtaattccagctactcaggaggctgaggcaggagaattgcttgaacccaagaagtggaggttgcagtgagccaagatcaggccactgcactccagcctgggtgacaagagcaaaactccatctcaaaaatagtaaaatactaaaaaggacaacaaaaggagcaaatgccccactgacccaccaaccacaggacacgttcatgtctgcagtattgtttctctgcaaacacacctgtaacgggatttaaaatgggcatttccatctgaaaaccagagacatgaatcccaaggcaggagccctctggacataagaatttacaaaggaaatgaataaaaaccagctcccgacttgtaggcctcttcacccactggagacgagagaacacccagagggacccagaaagtggggttagtgcaaacgatgtggccactccaccagctaacacccagcctggtgagagggctcagggccacctggagggtggactggtgccccccacatggagatggtgcctgatgccacagcagcccagccatgcaggggtgggccggggagggcacctccagcctccagccagtgagcccaagaacacctgaggctgctgggatccaggtggggaccacgcaggaggggcagagggccctggcatgaactgtttgaagactggcttaaggacccatgggaggaccaggatccccagtgcctgacgtgctgggccaatgaagggcacagcagaggagtggacaggcacccagggagcccgattcagctggaggccacccgcatcacccaacgtcagagcccacctccatcgacccaggaaagaaaggcccctcgccgacccaggaaagaaaggcctctcgcctctgatctctcccgccagcgcctcgatcagcaagtctggaaggaagaggtgccaggagagaggaagtggccgtttcccacaactcctgtcccaacagagttcccatgagttccgcggctgacccacatccccctccttcccgacatgcctggcgcccctcacctggcaatgggagggcccagctgcaccagggatgggtcctgcaaccacagcttcgagggtccctcacctggagcattgctaccggaagctctgcctgctgcaccccacactgcttctccctccctcactcttcactccactctgcacttatcaaggtcattaccacaggacacgggaaaggagagaggccatatgcccaccgccatcctgaagattgagagctaaggacatgagtgtagagaggccggtggtccacccagaccgcagtcactatggctgagcccaggcctggaaaccgaggagccgccccatgggaagtccgtggccacagcttggggctgcaggcagagtggccctgggctcacgctctaccttgccacctgtctgcatgggtccctgaatctccttgtgcctcagtctcctcacctgcaagatggggacagtgaccccacatgcaaggagctccaagggttgaacctggtggttgaagctcacagcccatgccggggtcgctggctcggcttcctcattgccattctcccaacaagcccactcgcctccctttccaaaagacaggacaggtgccaggaaaagccgatttcaagtccaagaccacagccagtagcaggcaggacccaggccaagcctcagactctaggccaagtgtcacctgccaccttccacggtgacacacggagccactgggactggctggccaccctgccgtggtgggcaaagggccgtcctgggagttgcatctgacgctgcagcattggttcagcgagtgtttatccggggctaggacaagccaggcacgcagagctcacgtttccacccagaggtaccagggggtggaaagcagagaaggttggggccgggaggagcagcggcagcaccattcaccagccaggcagccttggcaggttatccaccttctttgatcctcagtttccccatctgtcaatagggccacagcgggtgactctgtaagattaaacacatccatctgccagcctgcaggtaaagggctccagaaagcacctagaggccagcaggcccccagcaacatgacttccgtctaccaaccaattatcactattattactctcctgagattccttttaagggaaatgaaatgcagacaatgggcatgtgttccctgccttcaacactagaaggtgccttcatacccttcaccccctgggcctcccaccatgaaccttcaaaacacacggagaccaaatcgaggcttctgtgggtcctggctcacatcccaatgtttcccaacatggtgctggggtcaccaacgctgggtggtagccttctccaggcctagcccacccagggatgtctccgccaggaagggcagggctcaccaacaagacccgtgcctcttcaggtagaaaccttttcccttttcccaaaggccctcaggaagctccaagctggcctggagtaacagtgggtcttcgggcttcatatccagcctcttcctcctcctcctggtcccagccttttctctgctgtcatccccctggtacgtccaggtgagaatgtgagcgccccatgcctggctcacagtaacctcagataaacactgactgcatgctacagcaccagatgtaagctaccttctgttctttctggcattcgatggcatgcatatctacaaatttctccacatcacaaggcctcacagggtgagtggaggggctcaaaagcccaggagcatggagctgggggatgggaggcatcagccgggaacttccagaccccacagaggccgggaccccatctctgctctcttcatgctcaggggctcttgctgatacccgtgcccctgagtgtggcagggtccggccaggctctccacatccagtcgtgcaccctgcacacatcccatagccaaggcagatgggccaatgtcctgcctggctcctaccggccaagccacgtgtccgccagtgtggccgggggcacggcagcactgagcagccagcacttttccctgatgcctctacccagagaggctgggttcattccaaccacccagagaaagggcctttctgtagctgctcctcccaaagcactgctagtttcaaactggcccctagcagctctgggtgctccttacaatttgccgaaagaaaagaagggaaggagggagggaagctggcgctcctaggccagtcgacccccacatgtggcccctgccagcagcagcacctgaaacttttcacacgtgtacatcctcaagcctggccatctcaatcagaaactctggggcagagcctgggaatctgcattgtcaacattccccagggagttctgacgcacgctcatgtctgaggggcgctggcagacacctgcccggcactgcataggtctcagcttcagaaataagaaccactctataatgttcaccatggacttgtgttattgggcccccgcccacctcacaagtcagtgtgcccgtcagctgtgcttaaaaaggccacaacctgcagggcctgggaggcaggcaggcaggctcacctggcaacaggtgctgctggggcccaggcccaggtgtggattagccaactgtggtcggaactgtggaggcacccaggcctacccagaacccccacaggtgtgggtcccaccaccctgtgaggctccgattgaattactcagaagaatagctggccccccacacacaccctgaaacgtgagtagagggctggggagaggtgtgcaggaggctgtgcccgctgccctgggccgtctgctggccactttgatgtgaggagtgttgtctgggctccacgcctcctctttgatttttaggagcagtgcagtgtgcccagtcccatttggtggtttttaagcaagaactcttctaaccttttcctaagaaccactaattatctcaggcgggaaacccaatccaagccgttctggcagtagggaagattccccctgctgtgcccagctggacagagaccacatgaaaggccccagcctgctcgctaagaccccgctcccaggccccagcgacagactgggcatgggtcttggaccccatccagccacctgcactggggacagcatgtgggagggaacctgggagaggaacctgatggccactgagtgctcccactagtgataccaggcctgcggggccggcagaactgctgctctggtcagccctgtgcttgagccctgggggcagaggacctgccagcccggccctgcccagccctgccaagccccgccccacttctgccccactgctgcccctggcactgcacctcctgccactgcccagcaacgtccctgtggctgacccctgcctggcctcctcattcctgctttgtcacttctctggctcttccctgggtcttccacatcagtccacacaggatcctcccacgtgaaaaccaccacaatatcctcttgaccccgcctcccctttgcagcgagattccctgagggccgtccatcctcactgtcttcaatgcctctcctctcgctctccttttaatatttggcacatgcaaaagaacatatgtaacatgtgcatgttcctaaggttaataccatgaccatgagccctgcccagccccgccaggacaagaacttcccctggaacttgctcatggcagtcagtcccttcccatcccatccccatttccccaagaggtggccgctccctggaccataggcttctggccatcttgtgttgaagtaatctcagcactaaccagaccataagcttctggccgtcttgtgttgaagtaatctcagcactgaccggaccataggcttctgggcgtcttgtgttgaagtaatctcagcactgaccagaccataggcttctgggagtcttgtgttgaagtaatctcagcactgactggaccacaggcttcaggctgtcttgtgttgaagtaacctcatcactgatgtatgcgtgcctacatggtatgttgtttaacctttcttttgaattttacatgaataataccgtgccgtgtggagacttctggaacttgttcacccaacattatgtttctaagattcttccaggtagctctttgcagctggagttcattcatgttcacggccgtgtaatactccactgtcaccaagctgcagcgtacctgtcattctgttgaggacgtttcagctggcagatgtgttgctagtactgatactgctcttaggatcactctgccgactgtcttccagtgcacacgggcagcggtttctcttgtgagtgtatctagcagagaattaccaaggtatgtcctattcaattgcaagaaatgacaccaaacaattttccaaagaggttgtttcagcttagcttgactcttcagaataaacatgtaagtactaacaattaagatggtccaacctcttccattttgaccatggagtgagtgaaatgttgtgtttcagtttcattttgcatattcctaataactagtaagacggagcaacttttgacatagctatggaacccgggtgtttgcttttctgtgaaaagcccaactttctactgctttgtctttttcttcctaatttgtaggtactctttatgtggtctggatataagttcttagttgttctcagttaccaaaatcttctcccagtgtgtggcttgcctattttatggccttttttaaagaaagaagttcttaatttaaatatattgagttcatcttctaaacgttctaaaacttgcttttcacacttaagcccgcctccagtcggtatgtacttttgtgttaggtgtgaaacagggaacttatttctttcttttcccacctgggctggaatttctggcagcatttattaaataaccatcccttccctgcgggtttgctgccatccgtcgcagttccgcatttgtgcagggctcccgggctctctccccttagccgatccgccccttgcgccggtgtgcggggctcccgggctctctccccttagtagattcgcccttgcgccggtgtgcggggctcccgggctctctccccttagcctatccgccccttgcgccggtgtgcgtggcttccgggctctctccccttagccgattagctcctgcaccaggaccacactgctgtggctgctgtcccagcaatgtaagtcaggaataatggagcagcaattccctcaactggattctcccacagaaaggatttttgctcttgtttttgtactttcatgttaatttttcaatcaacttatcaaattttgcgggaaaaaaaatggcattatgtttagaattataatgaatgtatggatgaaattggagaaggctgacatttttacaatatcaattctttttgaccatgaagatagaaaaactgtggtggccagaattccaagatgaccccagtgatccttacccttacataatctcctcccgtgaataagtcactcccggaattgggatatgttaggtggcacacaggacttttaaggatgggcagttgtcctggtgggtctgacctaatcaggtgaaactgtaaaccacacaggcttttcctagagattcaaagggcgagtgggagtcaatgtgaggcagcttctttgttgctgactttgaagatggaggggaccctatggcaaggaatgtgggtggcctctagtccctaagagcagcccctggctgacagccagcaggaaacggacatcagcccaacacctgcaagcaactgcatttggccaacaacccaagtgagtatgggagcagactcttccccggagctcccagaaggaacccagcccactgacaccccaatttctgctgaacggaggacctaccaagccgtgcctggatgtctgacctgcagcttggagctaagaaatgaggttgtgataagctaccaagtatgtggggacttgttacacagcaacagaaaactacatagtctcaatttacttgtatctacagtcatgggctttaatgaagttttatagttttctgtatataggccttgaatatctttccttccatttatttttagaaaccttaagaatttttaatcttatttaaatatcttttaaaaaatgaatataactgaatccttgaatataatttataagcttattgctagtgtctagaaaagcaattgatttcagtatataatctcagggcaggccaggtgcagtgactcacacctgtaatctcagcactttgggaggccaaggtgggaggatcacttgagcctaggaattcaagaatagcctgggcaacatagagatactccatctctacaagaaataaaacaattagccagacctggtggcatgtgcctgtagttacagctactcaggaggccaaggtaggaggactgcttgagcccacaagttggaggctgcagtgagccatgatcacaccactgcactccagcctgggtaacagagcaagaccctaaaataaataaatgaataagtaataaagtaaaaactttttaaatctcatagcaaacaactgtgctgaattctttttttttttttttttttttttgagacggagtctcgctctgtcgcccaggctggactgcggactgcagtggcgcaatctcggctcactgcaagctccgcttcccgggttcacgccattctcctgcctcagcctccccagtagctgggactacaggcgcccgccaccacgcccggctaattttttgtatttttagtagagacggggtttcaccttgttagccaggatggtctcgatctcctgacctcatgatccacccgcctcggcctcccaaagtgctgggtgaattcttactattcttaataattttggcttttctatgtagacatcatatttgagaataaagcattacgtttcttctattgctgtttttatgtacttacatatttattgcatcttaatgaggcaggaccctcagcagcatgtagattttgctgttgctgattgtaaaggccctgacagtgacaacttccatttggaaagctgtttgctgaaggttttggcagcagggcgtccacacaagaggggtacacagtgtgggagtcaaagccccagtcggatgagcagggcatctctgtggggagtgggtggcagtgatgggaggctggggacatgcaggaaaactgacccaataatagattaaggagaatgagaaccattcccagaaagggccttacagctatggaaagagagaaaaactggaacgtaccctgtggtgctgggctaaaatcggagacagagagagagatggaagtacgtgcacatatcctctagctctgtccactaagagctcccgggtgcagcaatctgcaacagccaggagcacgcctcgcacccacatcctggttcctgatgctactctccattcaaaagaacaggtcttcttagagctgcagctcactccaataaatgaaagagaaaggggcaggcaagtataaaataaggcttgaacatctttttgcaccagaaagtaaagaaacagctaaagaactgtaggtacataacaaaaaaacacaaaaggcagaagaaggggctcccacgggccaaacaagcaggacctgagcctgagagtaaatgtcataacagaccacagccctgaatacaagaagggaccaggatccacacaggtgggagcaaggaaggaaggaaaaagtaaaggcagtttgacagggatgggatattggcatcgcttcacactacctccccactcattcattacaaaggggtcgttcactgggcagtggagaagctgaccagggccaccttcaccaagcaacaagagagaacaccagcaggaggctaactgcattgggcagcccctgccaggaggcagtgtccatcctgtgacactcctagacaaaacgcagacccagaacctaccacaaggaaacgtcacatgaacacaacctgggagccatgggcttatctccagaagtgccaaggtcgtctaagcccagggagacggagccaccgtccaggcagattaagtcgccatgaccacaaagccacgtgcgactcactcctgacatgaatgcgggttggacgccgtcccaaagcacagagggtgcagggccagaacggcaaccactcaagtgactcagaaggaagcttctctttactgtgcttacaacttttctccaagtttgcggtggtttccatattgttattgttattgttattattcaacacgagtaaaaagaaactcatgaccttctccttggactcgctcctctccccaatctcgataccgactgcactgttgttcgggtcgccccctcccccaccatcccacaggggctatggcgtgggctcagcacctctgaaggaaaagcagatgaaagaacttgtgcctcccaggcgagaatgcacagtgcaggggcaaccctggcagggcccatcccttcctggtcccgctgagctcgggcacagaccgggcaccaggctcggtgtggagtgtgatggggagtggtgtccccggagttgtttctgggagttgctgggtccaccttaccttaaatgtagtcaaccaagtcccatcccaccactagatggcacccaaacctcagcagaaagggggcgtgggttggcccctgaagtgagaaaaccattggtcaatctggacctggcgtgcttcaggtgacaacaaggctttccacacactgctcgctcgccccacctccccaccccaggccccctgccacacacctgaagacacaggaaataaggtcacccattggcttatacatgcctttgagcaaaacagaaaaggtgcccctcactgcaggtagacagcccccagccaggatacacctcacagccatgtgcccttgtgcaatgcacaacccaagcaaccttactcaacaaccctactccagagaagcaggactagaactgtgctgaagtgaagaatgacaatcccattctttgcaagacttattgatgaaaataactggcaatcagaaccctaaagaaacacacccagtcacactcatacaagccatgaaataataaaacacagtcaaggttctctccatgtcaaaccaccagcatccccacctgaatgccccggaagtctgacggttaacctgtgcaggccctggtcaggcctgtggtccccaagggctgccggcagcaaaggcaccacggaagctgcaggggacaggggaggccgctgcttcttgcatttttgtctgaaaggtccctgtggagtcgacgagggaattctcactgaagcagctataaaagaaagcggagggcacggcgcctccctgaagcaccagcagctgttctgtagatggttgttgggccacacgcaaaggacttggttcctgtccccagcttagtggtccgtcagaggaaaggtctcttcctgcctggctggccacagcatggccgcctcttccatgacgggcacctgtgtaggccagcctctctctcctgccgcccctgctgggacggcagcccggacgtcacctgcacagccacaggtgcgggtgctggctcagcctctctgtgagctcatcctccccgggctcctccagaatatccctgtggaattgaggaaagatgcacacaggggcctctaaaggagggagaccctggcctgcccacaagaacaagggagcagagcttagcaacacatgcgaagtgagtgtcatagggacacagagacacggggactcagatgagcctcaggatggatgtagccactagaaatatctacacggcattcttaaaagcccaggggccacgtcttcccactggctggcaggaccgcagggcttggctgcagcaactcggcagcccctggtggaaggcacagaggccccacagcagggctgcctctgggtggtcacttttctggactagcagaggaaccatctcaaagctgccaggagaagagatgggtgcggtttcctcaggtcccttgtttacatccaacaggatccaatggaccctgaaggatggtgccttaaatatgcccaatccaagagcaggagagcaggacaaaggctatgacgccagtggcaggaagaagaagccgccccgatcccggctctgagctgctctcctagagcacaggaccaaagccagataaccgggcggagggggaggacagtcatcagggcctgcccgccgcctcaacccctccaccccccagctcttggcttcccatcccagggggccagacagaagcgccttccccacccacacacctgaacaggagctccacagtcatctggtaggtggcctctggggtcccagcaaggggctgcaggtggctgcgggggtcccacttgtgaaggaagttctggcaagcaggaggagtggccagtgagtgtgggccccgaatgaaagcagccttgccccatccccggcccctccagggtcagccacagggcacccgctgagggggctgagccattcaccctggacacccaggcacaggccccacgaggctgctggctcctcctggagccaatgtccaagtccctccttcagcccgacctgggggcctgagaatccccacagcccagatgtcaggagcaccccccaaggccccagcagcccagatgtcaggagcaccccacaaggccccagcagcccagatgtcaggagcaccccccaaggccccagcagcccagatgtcaggagcactccccaaggccccagcagccagggcgggcagcactgagccccacgggaggggctcagcctcactcaggacccgcctaacccagcacgactctcccatcaaagttccaggcaggcccggccggtggcctcaggcccatcgagagtgaattagaaacaaacgaccatggagaacagcctgggtggggatctctgatacctccagaatcagggccagaaacaggttgacccagatgacagacgacaccagccaccacaatacaaaatagatcttggaccacctgcggaggacagagacccaccctgtgaaccacgatgagcaaagcaagagcactcgatacaaacaccactgctgcgtggccaggacagctctcgggcagccggcccacacacaccatgatgcagagcgcgttactatttccatctcagaaacaacccaactgaggcctagaaacgtgcaacaagctgccgaggtagctaagccagcaggaggcggtgctgggattaaaacccaggaccatcagctggggccagtctgagctcttcaagctcagagctgaactatctcgttcactcagccttcccggggctcccccacccccatggaattcctcagaagccccaaacacaccaacgacctccaggaggtgtaaacccagagtcactggccaccatcctgagagtcacgatgtggctatgcagggggcagggacaaggcaagccaggatgccacgctggccgacttccctgtcaaggcccgagtccccgtcccagccacgctccgggcgtccagtgcagatgcagcgtgcccggaggtgagggaacccccaggctgcacggagaatcactgccgtcagggagacgaggactcacgggcctgagtagcgccgatatgcatccagaaacacctgccagttgttcaccaccatcaagttccacagagtgaccagggcagcctgcgggggcagagaccagcggtccaggagggcccaggaggtagggaggggaggagcccggggagcagggtgctgggacagggcgcagggctcaccgcaaagtcatcgaagttgttggcccagtactccagctgctcgaagctcccacagggcgccgagccattggcaggggccaggctggggaacacaacacacctgggtcaggggcgggggctccaggttctgaggcctgataccttacacccctttcctctgctggcgtgctcagcctggcctgaaggtccaaattgggatacagaggctcagagggcagggaaagtgctgctctgagcaggccacgagaaatgtgtttagcagactccaggcaagggctcctaggagaggtgcggagcggaggtggaaattgggggtcgggaaaagggggtggagggaggagacgaaggaactgggagaacaccctcccatcctgagatgctgagcccactgaggccaccgccaaggcttcccgcccaccccagcacccctgagacactccctgtggcacctcggaccccacctcacctgctgtttccaggaagagccacaatgacgcctctaaacaagttgatcccaatgatggcaaatacgtagtagaccacctggcgggccaggagccggggactgatcagccccacccatgggtgcacccaccaccaccctccccagacagaaccgcaaagccagaggatgactgtgaggccaggaccctctgcccagggctgggattccagcctggctgctacttcaaaacacacgcagctggcctcccccagggctggcgggtccacagacacagtggggctcaggcaggcgtggtcatggagctcctaagggaattagggccctgcccccaggtaccctggcagccacagttaggggacaggctgcccgccaaccccaggcctgtccctaacatgcgtcagcagagtggaaggggtacacgcctgggctaacctggtcctctttctgggcctcagtttcctctgctgtgcaagttagggggctgggcagacagcacctgaggcaagattctcttcccagcgtctatttccagaggcgcgaggcacagctggggtccagcccagagcaccctgcggccccagagacaccttctcaccccagtggtccctacgtcaaggtggtcagaataaaatggcaaaactgcctgaagtgtggccgggcttcctgcaaagggcgcctcctgtcactctgcacggcgtggatctggggcctgcctggtcacaggcccctctcctgcccaagcccggccaccaggcagagcagatgggctcctcagctggaaggctggcccccagggaggggccggggcgtcccacagttctcgctcagcaaatgtggctgtgagtccctgaaattcctctaagaaaggagcctcgaccaagtcctcatcccagggcttgtgcaggctttggggtccctggagcaaagccctgcgcctcttaaatttctgtcattactttctcaacgagatccacaacccagaaaacacgagagactcaaaaattaccaaacagtctctgccatgggagggaaggatgctcaggcagggccaccagccacaccacccgagctccctgctgtacaaagaaggggatgcctctggcttcttaccccgaccctgtacttccctggcctcaggaacctgctgccatccgaacccaagaaccttcctaccgacagagcagtgagccggcccggcactgccttccgccagcctcccagcctcccactccagtgcataacccgccaccagcagcagcctgggactcaccaccaggatcccgccaaaagcacgcatgttctgcaccaggcccaggacggtactggccaccacggccatcggctgaggacaggaagagagcacagcccttactcctcctggccccactgaggggacaccatcccggcccaccacgctgaccctgacagaaaggcaagatggggcaggccaatgaccaccaacccacacacacacacctggacccacagccacccccacacgcctctacacacccacacagcctgtcaggcccccacgtccacccatacacaccctcgcaccccaacacctacatctacccacacgcattcgcacacgcttgcatcgccacccgcacacactcactcacccactcccgcatcccaacacctccaccccagcctcattcaagcacggacttcaaattcctgtgggaggcccttctcctgcctcccaacccactgcaggtgggtcagctactctgtggcctggagacgccaaagaaatgcagagctagaggtggcaggagcacctgcaggaactgagtctgagaaggggcctctgagaaccagcagggaggccccggctccaaagagccgctcctcctcatcacagcctagccgggagaaaggccttcacatcagccccatcaacccacctgaggaatccaaactagacaacacagctgaacgccacagtggagaccagtcagcatgtacgtgtgcacacgttgcgtgtcatcgtgagcatgtatatactcacgtgagaggtcctgggaaactgcgacttcaagcaaaacggcatgattgcagggtctgctgtgcgccatttcccttaaagtcacagtttccaagaacctgtggatagcactgaggccttactgtggatgtgtgcacacacgatcatgcatcttacacgggcacaagttcacatggatatctgcatgcgatgtgtgcacacacgatcatgtgtcttacacgggcacgagttcacaaggatatctgcatgcgatgtgtgcacacacgatcatgcgtcttacacgggcacgagttcacaaggatatctgcatgcgatgtgtgcacacacgatcatgcatcttacacgggcgcgagttcacgtggatatctgcatgcgatgtgtgcacacacgatcatgcgtcttatccgggcacaagttcacatggatatctgcacgcgatgtgtgcacacacgatcatgcgtcttacccgggcacaagttcacatggatatctgcacgcgatgtgtgcacacacgatcatgcgtcttacacgggcacgagttcacatggatatctgcacgcgatgtgtgcacacacgatcatgcgtcttacccgggcacgagttcacatggatatctgcatgcgatgtgtgcacacacgatcatgcgtcttacccgggcacgagttcacatggatatctgcatgcgatgtgtgcacacacgatcatgcgtcttacccgggcacgagttcacatggatatctgcatgcgatgtgtgcacacacgatcatgcgtcttacacggacatgagttcacatggatatttgcatgtgattatctgtgcatacggtgatgcgggcgtgcgtattaatgtacgtgtgtatgtgcatgatgatgtgtattgtatccaaacatgattgtatatgtgtgactgtgtatgatcatgtgtgcctgtgattgtgtgtgtatatgcatgtgcatggtcacatgtgtggttgtgtgtgagatcacgtgtgcttggctgtattgtatatatgtatgattgtgcctgtatggctgtaattatgtgtgaacacgtgtgcgcgtgtgtgtgcgtatgaaggtcccagcacagcagccccgtaggaaggctcaggacccctgagctgccttcaagtgggacatactgtcaggtgggacaggtgcacagctcagaggaaggatgaacggggacagaggagggacctggacactcagaacatgggtcttaggacatgatgccaggagcagcaaggcccagacccccgacctctgcctgcctgcccctttaaggtgcccattgctcctaaccggtgcattaagagaaaccagccctcagagatggtcatgagccacctgcgcccgcattagaggatcctggaaacaagctccctggccaggggtaccactgcccctcattaatagcaccctgggagccatggcaaaggcctttctgggaacctcagagacctgggggagcactggtgtccagggctccagccccaaggagctcctgccactggccaaagcattgcacccgccacacccttgcccgccttcctctcccaacccagaaatgcagggctgggctctcctgcttctaatgacccttccccagcatcacaagagcacggcagagagctgagggtgcagccagggagcccagggtgatgggcacagtcctcgggcccttcctgccccaggctcacccaccctggagcaacgcagcagcatgacccaggagggtggggcgagtgggggtggggccggcacacaccttcatgctggggatgatacgcaggaagcggaacacgatgagcatgttcagcatgcgggtcatgtcccacagcgacagcaggcccaccatctccggcctcctggggagagacacgggaggcgggttgggaggagcccaggagccccacagggaggagacaaggaaacgcgcgggttcctggacggaggcgcagggagggcaacagggcatgacgggagtgcaccccacagccaacaccgagcagaaaagcctctgcagggtggcgagagggcggggcctgggctactcactgctccgcttccacctgcagccccggagcgacccccatccccccaacaccttcccagccagccctcgcgggaaggctgcagccctccttctacacagaccctctgtccacacgggagggcatggaggttccagacactgagacttgctccagctcaggccccagcagaactgcgtgagcccatgtctcctgccccggtctcctgcgccagccccatcccctggttcctgcccccatcgcccacctcctgtcccatgaccctgaccctgaccccatccctgacccaagccccgcttggcatccctcatggtctttccatgctttcatttctgttgaaactcaaacccattctcacccacagtgtcagccccccaaggtaatgactcagaacaaagtgcagcgggcatgctcagtgcacatgaaagacaaggcaatgccagccccacggcacagcacagtggcactgcctgccttcctgaggtaagttctggggggcttcctagggagctgacggaatagcaaggctcttgctgtccaccgtccccacccccaccaagcgactcccagctgctccctaggcagtggggtggatgacacagcacacagagacccaaggagcccggcctaaccacagggccgaggctggcatgctgggccccgtgccccacccttcctgtctcatcacgggcacaccagagccacgctctcagggcagagcagcctggctgacagccctgtggtgccacgaggctccagggtccctgcccaggttgtctcttcatggccagaaccccgggcagtggtgaatcagcacacagcctcagagttcagtgagccccgggcccctagctccactattttaaggaggctaaagtgatgtccagagtgggaggcgatgactcaaggtcacactgtgaggcaggggctctcccaaggaccttcccgccagcagaggggcccagccgaatcccagtggtcacaggtcccctgagacctgagccaggggcatctctgctgccagcccccagcatgtgtgctgggagggggagcccactgccgcccgggagggcatctccaagggggaacaacggcttccctccacagcctgcggggtgccagcttctggagagaggacccccagagcgacggcagggccctgccccgacacagcctctgctgtgggatcggcccacccattccaccatcacggggtctgccctagagtcagagcagacccagccccctggacaccactgagaccctcccaggggcgctgggtggtggtgctgtttgctgtagccgccctcggttctgcccagtcacataccagcctgggtgtggcaatcggtacacagccagagttgagatctccaaaacctttaattacaaaagaaaagaaggcttcgctacagcaacactaatctgggcggcccttaaaggaattattataaagctcatctctaacacattctccccaaaaggggcttttggggagaaatcagagcttggtcctggaccccacgggttggttccagatgtcgggacttctttcagctggaaagacaccctggcctcaggaatcgggggactgcacagattggggtggcagaggtggcagagaagatactgagtcaaggacagactgcagggcccttttcaaatttctcttcacccatgtgccgaggggcctgctggctacagcaaacgtcactctcatgtggctgcttgtgacacacacaccaagtgtggcatgccctcactcccactgggtctggggaaaggaagtgtaagcgtttcccaagaacaccctggtgcctgagagccccctggcccctcgctccacccatgctgaggtcacaccgtctatcagtgacgtttaagaggctgttccccgggctggagtcgctggccagggctacaagtccttcagggcttcccctgggggtcgggaggggcagcctgccccccatgacactcggatgcagtagaaacccagcctcctaaagacctcaccggctgcccactgagcaactcggccagcagggaagccagccctcaccactgagagcagaagcccaccttcctacagcctctagtcctcaggggaggcctgagatgggccagcacagagcccaggtggcgctcacccacccgcccaggagaggccggcctcggatgcgcctactttaccagcaggacaacggtgaggagcccgtcaaacacgttgctggggtaggacaggtaccctcgcaggcccagggcaaagaccttgagcagcatctccaacaggtagtacacaatgaagacgcagttgagaatctgaaaggggcagaagaggcacccagcattgggccccagggctgccagcactgcccagcctcaccctggccctgacaggtggacagctcagaacttacccccaggatgaagtcatcacgctcagcaggcagcacatctgcatccagcaccaggaacacctgcaacgccagaacagagggctcgccggctggcccagcacagcgctgggcgaggcaggaggggcaggctcccctgcaaggtgggcgggaaccggcacttccgcgccagctctggggcaaatccacactcacgcaaatggacaccaggtttgccagggcgatgaggttccccaggtagtcaaagtagtagtggccgaagaggaactgggcgctctgcagaaacggagactggtactcgggcctcggcgggtgctgggcaaggaacacacgtgctcagaagcacaggccagcagccgtggctgttgcagcccaaaaatgctcacaccctcttattttgggatttgattttttcctaccccatctcccgtcctatctatccagccacaggaaataatcccagacacagaaatcgctttatacacaaaggtgttcatctcagtggtctttgtaacacccaaagagaaatagaagcaactgaaacatccactgaggctgtaagtaaaccatgttgtgatattagagtcacctgaaacatacgcaaagtgtcaccctgatatatataaaaaaaaaaaaaagctgtgtgaaaaaacacaggtaagtgatatactcatagctacagaaactcagcacagaaccaactcctgtactgtggccagcagcagcaggaggcaatgaggggcaggcgggcagacgctgccactgtcaggacccttgtgagacccagcacttcccacgctcagcagcctccttgagacacgtccgtgtgtgcaagaggtcaacaaggggaatggcctaaacatttctcagcaaggagacctgcacccgctgtcccacacgggagccactgaccaccggcggctatttcatgaaaatttcaatgcaacaaaattcaacactcagttcttcggtggcaacagccacgtgtcaagtactccacagccacatgtgacacgtggctacagctcatccccccagaaagtccatatgaaaatggagagggtaagaagacatggctgcgtgaacaggcaggctgcagagtgaaaatcgcaatgcttcatgtatacgtcaaagaagaacaaagcaactgcttccccaggtaactacaaatgcctgaaattacacagggaaaagtctggaaggaaaacaccaaaatatccagttgaatagagtggctattctccagtgagacccaaactggtggtgccaatgatcagcgaacttcctctcggctcccgatatcctcctcgatacgcactctgccacaacgggcagggtccctttcagcgtctcatccacagtgaacgggagttgaggctttcttagcggaggggctggagggacacagcaggagggcaggagggcaagtggagggacatggcaggagggcaggtggagggacatggcaggagggcaggtggagggacatggcaggagggcaggtgaagggacacggcaggagggcaggtggagggacacggcaggagggcaggtggagggacatggcaggagggcaggagggcaggtggagggacgtggcaggagggcaggtggagggacatggcaggagggcaggtggagggacatggcaggagggcaggtgaagggacacggcaggagggcaggtggagggacacggcaggagggcaggtggagggacatggcaggagggcaggagggcaggtggagggacgtggcaagagggcaggtggagggacatggcaggagggcaggagggcaggtggagggacgtggcaggagggcaggtggcgggacatggcaggaggtctacacgccgggcctggaagaagcgagtcc

SEQ ID NO: 28 - DNA, 5962 bp, Homo sapiens
gcctcccctacccccattacctggaggtgcccacgacccgccgctagttgcgctcaggcgggaaacgcgctcaccgacaccatcagcgaagcgcccaaaatggcggacgtatcaagcaggccttgagttcccccccgcccgcccaatgtaattaaagccacataccccttaaaattatgggaggtacctcaaactgaagacacaagggtattatatgacccctccatatggccgaggaagttctgtcactatttgagcaagtcaccacatctctctgagcttgttttcttatctgtaaatgagaggtttagactagcttttttttttcttttacaggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaaggtaagaccattacgattagcaggtgtaaatatcctgttcttctaggtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacaggtaaatatgattttccaaaatttctgatctgttcttctctagattgtggatttcttaaagaagaagcatgattttgtagaccttattataaagcacataggaacttctgctatcatggatttgttgctcaggctcctgacgtgtatcgaacctccacagcccaggcaagatgtgctgaatgtgagtagaattctgacctgttctacaatgtgttttacagtggttaaatgaggagaaaattatccagaggcttgtggaaatagttcatccatcgcaagaagaagatgtaagttcacttgtgtgactattgtacttttttcctttagcgacattcaaatgcatcacaatcactttgtgaaattgttcgcctgagcagagaccagatgttacaaattcagaacagtacagagcccgaccccctgcttgccactctagaaaagtatgtgtaaaactctgttctattattgatttgtttccctaggcaagaaattatagagcagcttctatcaaatattttccacaaggagaaaaatgagtcagccatagtcagtgcaatccagatattgctgactttacttgagacacgacgaccaacgtaagcttttcttatatcttattccttgctttgtttcaagatttgaaggccatatagagatctgcccaccaggcatgagccattcagcttgttcagtaaacaagagtgttctagaagccatcagaggaagacttggatcttttcatgaactcctgctggagccacccaaggtaggggagctatgttaagctggaaagctttttcttcttcagaaaagtgtgatgaagaccacatggggtgtgctggatcctcctgtggggaatacccggttgaatgtcattaggttgatatccagcctgcttcaaaccaataccagcagtataaatggggaccttatggagctgaatagcattggagtcatattggtgagattttccctgctcaccatggtttttcttttttgtagaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatgtaagcttatttggtctcgtattctttttttttttttcagcttttccaaaaatgtcaattaatagaacgaatacttgaagcctgggaaatgaatgagaagaaacagtaagtaaattgtttttttgatgtcctttacctcttgtcagggctgagggaggaagacggcatggttacatgggacacctaacgaggatagctaactgtatcgtgcacagcactgacaagggccccaacagtgcattagtgcagcagcttatcaaaggtaagttatttgtgaaattttttttgcttttctcactctgaagatcttcccgacgaagtcagggaacgatgggagacgttctgcacaagctccttaggagaaactaacaagaggaacacggtagatctagtaggttttacaaggttacattttacatttttatgcatataggttacaacctgccatattcattcatccagtgatgatgaaattgactttaaagaaacgggtttctcacaggattcttctttgcagcaagtgagtcacgcctaaagctttactggtcctggggttgccaggccttttctgattatcagatgcaacaaatgacgtccaattttattgaccagtttggcttcaacgatgagaagtttgcagatcaagatgacattggcaagtgagtatgtttttctgttttttattttgtttttttacagtgtttcttttgatcgagtatcagacatcaactttactctcaatacaaatgaaagtgtaagtataaactctgttgtgttcctctcatttttatttagggaaatattgccttgtttgaagcatgttgtaaggaaagaatacaacagtttgatgatggtggctctgatgaggaagatatatgggaggaaaagcacatcgcattcacaccagaatcccaaagacgatccaggtgaaagatagttggttatacttgggtcttgtttttccttagctcggggagtacagacagtgaggaaagtacagactctgaagaagaagatggagcaaagcaagacttgtttgaacccagcagtgccaacacggaggataaaatggaggtggacctgagtgaacgtaagtggattcattcttcaaatttctcccctctttttagcacccaactggtcagctaactttgatgtcccaatggaaacaacccacggtgctccattggattctgtgggatctgatgtctggagcacagaggagccgatgccaactaaagagacgggctgggcttctttttcagagttcacgtcttccctgaggtgagcgaacatgtgctgtctgaattttctcttttttgaaagcacaaaagattctttaaggagtaattctccagtggaaatggaaaccagcactgaacccatggaccctctgactcccagtgcggctgccctggcagtgcagccagaaggtgcgtgcagagaggcctggccatcagctgtgttcttttcagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaaggtaaccaggggtgagatcctaccctgtcatcctctttactgcagtgaggaagggaaactgtctacctctcaagatgctgcttgtaaagacgcagaggagtgtcccgagactgcagaggcgaagtgcgcggcgcccaggcctcccagcagcagtcccgagcagaggtaaccacccgcctcctcaaaaggactggccaaccaagcgcaccaggtgacacttcagtgaatggccctgtatgacgggtgacgtctgctgctgctgactgaggactgcagaccgccaccactcaggggctctggaggggtcagctggagcccaccaagctgtcactgctgcactcactctgcaagggatcaggaccagcaacctttatattctagattctaagacattgtacagagaaattcagaagtgtaaaaatattgcacattgacaaataccaagaatttttgcgtatgtttatattgtattgttctaaataatgggtagcctgtgaaataagatcttgccacccatgtaataatagtagtaatactatagttaaaatggctgtaagaatagttttataaaagtgaatacacagatctattgtatttgaaacataactttgacaattattagtgtgaccaaagtattaggcggttttcatacatttttcaccttgtacaaaattatgaattcatttttcctccaggccgacaaggagttgtagaatgaaaatgccctctaagtgttattttggttgttctaacttacaaaagtgattttgaataagaaatatttggtgttctttttataaccagtttttgattggtaattgttttctgtattgtttaaaacggatcaaaaatgtaagtctattggtagagattaagtaaagtatttattgctacatcatagttgataaattgatgttatcgtaaagccatatgttctgttcaagtcttgtttgcttgaaatgattattcctacaagtgaaacactagactatttggagtgtatatggcttgtgttttgggattttttttttttttttttggcttttgtttttgtttgtttttttgtttcatttggtagttcatctgccttttaacccattcaccaaaatttaccttgttaacaagcatcaccaatgaacatttcagagcaatctgcatatttaacagacctaaaataaatcctattaggcaagtcagttgaaaatgctcgtgctgctaatggaattagagtgcgttcattttacaggctagtattttaaaagtagaaatcaaaatctggcaccgaagcatgctaattgtttactgtaccttgtgaggttttcactcataaatttaaaccagtgtatttttttagaactggtttgtgtatatatatagtgattatggatactaattcaatgtaatttataattttctatgtcaatacaaaaatacatcacagccttctcaaacagctcaagcaatatattgtatattgccatatcgtctggtgaaagggttaaattacttcacctcttgcacttttagatgcaaatcagtttttcatttctgtaatagaaaattattcacgtatttttacatcatttgtttttcctgaccagtatttaaaaccaaaaggatattctgaaaaatggccaacaatttttttagaagtagcatcccaagcagcgtgcctaaacattacattgcatatggaaataaaagaatcaaacgtctaatgccttattatttctgatttcctttttcattttaagtggtgtggagattccagcactcccaggacagtggagtcagcagtaagccctgggacaggtggcaagggtgggtcccttgacctttgcacgcctcctcaggaaccccctttcccgggtgagcccctctctgaagagactgtccttgggcctcctctggaagcagcacccccagaggacagggctcctcctgcttgcctcagggctgcctgacttgaatggcgttggacctcggggattactggtagataatatgctctggtctcgcctggtggtgagttttgccagccatggccagggtttggctccactggtggcacacgtggcctccgtggtatggacctggtggcttctccatcccactgtggcctctgtggtatggacctggtggcttctccatcctacccaaggtaacagtgtcttgcttcatcccactgactgctgggagagagcctctgggacttttctttggggcatcattttgttttgtctttcgtagcagggaaaggatatgacaatggggaggacagttcttttggaggttggaggggccaagccaaggacaggagcaagtgtgccctcattttgtttctacttttaatttctgtgtgttggccatactgaattatgagactaacagatgtctacaatacaatacctgtattcaaaataacaaaaataaagcctgattctttgtttctagaaaaaaaaaaaaa

SEQ ID NO: 29 - DNA, 6318 bp, Homo sapiens
gcctcccctacccccattacctggaggtgcccacgacccgccgctagttgcgctcaggcgggaaacgcgctcaccgacaccatcagcgaagcgcccaaaatggcggacgtatcaagcaggccttgagttcccccccgcccgcccaatgtaattaaagccacataccccttaaaattatgggaggtacctcaaactgaagacacaagggtattatatgacccctccatatggccgaggaagttctgtcactatttgagcaagtcaccacatctctctgagcttgttttcttatctgtaaatgagaggtttagactagcttttttttttcttttacaggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaaggtaagaccattacgattagcaggatactttctgcattttgtttagaccagcatgttttggaaatttgatcttcactcatcatcccacatagacacacttctagaaagagaagatgtaacactgaaggagttaatggatgaggaagatgttttacaggaatgtaaagctcagaaccgcaaacttatagagtttctgttaaaagcagaatgtctcgaagatttagtctcattcattatagaagaaccacctcaagacatggatgaaaagatcagatacaagtaagacaattcaatcttctctgtgtaaatatcctgttcttctaggtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacaggtaaatatgattttccaaaatttctgatctgttcttctctagattgtggatttcttaaagaagaagcatgattttgtagaccttattataaagcacataggaacttctgctatcatggatttgttgctcaggctcctgacgtgtatcgaacctccacagcccaggcaagatgtgctgaatgtgagtagaattctgacctgttctacaatgtgttttacagtggttaaatgaggagaaaattatccagaggcttgtggaaatagttcatccatcgcaagaagaagatgtaagttcacttgtgtgactattgtacttttttcctttagcgacattcaaatgcatcacaatcactttgtgaaattgttcgcctgagcagagaccagatgttacaaattcagaacagtacagagcccgaccccctgcttgccactctagaaaagtatgtgtaaaactctgttctattattgatttgtttccctaggcaagaaattatagagcagcttctatcaaatattttccacaaggagaaaaatgagtcagccatagtcagtgcaatccagatattgctgactttacttgagacacgacgaccaacgtaagcttttcttatatcttattccttgctttgtttcaagatttgaaggccatatagagatctgcccaccaggcatgagccattcagcttgttcagtaaacaagagtgttctagaagccatcagaggaagacttggatcttttcatgaactcctgctggagccacccaaggtaggggagctatgttaagctggaaagctttttcttcttcagaaaagtgtgatgaagaccacatggggtgtgctggatcctcctgtggggaatacccggttgaatgtcattaggttgatatccagcctgcttcaaaccaataccagcagtataaatggggaccttatggagctgaatagcattggagtcatattggtgagattttccctgctcaccatggtttttcttttttgtagaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatgtaagcttatttggtctcgtattctttttttttttttcagcttttccaaaaatgtcaattaatagaacgaatacttgaagcctgggaaatgaatgagaagaaacagtaagtaaattgtttttttgatgtcctttacctcttgtcagggctgagggaggaagacggcatggttacatgggacacctaacgaggatagctaactgtatcgtgcacagcactgacaagggccccaacagtgcattagtgcagcagcttatcaaaggtaagttatttgtgaaattttttttgcttttctcactctgaagatcttcccgacgaagtcagggaacgatgggagacgttctgcacaagctccttaggagaaactaacaagaggaacacggtagatctagtaggttttacaaggttacattactggtcctggggttgccaggccttttctgattatcagatgcaacaaatgacgtccaattttattgaccagtttggcttcaacgatgagaagtttgcagatcaagatgacattggcaagtgagtatgtttttctgttttttattttgtttttttacagtgtttcttttgatcgagtatcagacatcaactttactctcaatacaaatgaaagtgtaagtataaactctgttgtgttcctctcatttttatttagggaaatattgccttgtttgaagcatgttgtaaggaaagaatacaacagtttgatgatggtggctctgatgaggaagatatatgggaggaaaagcacatcgcattcacaccagaatcccaaagacgatccaggtgaaagatagttggttatacttgggtcttgtttttccttagctcggggagtacagacagtgaggaaagtacagactctgaagaagaagatggagcaaagcaagacttgtttgaacccagcagtgccaacacggaggataaaatggaggtggacctgagtgaacgtaagtggattcattcttcaaatttctcccctctttttagcacccaactggtcagctaactttgatgtcccaatggaaacaacccacggtgctccattggattctgtgggatctgatgtctggagcacagaggagccgatgccaactaaagagacgggctgggcttctttttcagagttcacgtcttccctgaggtgagcgaacatgtgctgtctgaattttctcttttttgaaagcacaaaagattctttaaggagtaattctccagtggaaatggaaaccagcactgaacccatggaccctctgactcccagtgcggctgccctggcagtgcagccagaaggtgcgtgcagagaggcctggccatcagctgtgttcttttcagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaaggtaaccaggggtgagatcctacctttaactaaagactcattccttcaaacaggttctttgacaccttcaccgagtctgcagttttgcttacgtgcagtcgtggacatattattcccccaaattcctcatttctaggagtattctgaaactcttgtacatttctttttctgttttgcacactgggcttcagagtgttgaaatcctatcggtatgtacagtgttatgggacctgtcatcctctttactgcagtgaggaagggaaactgtctacctctcaagatgctgcttgtaaagacgcagaggagtgtcccgagactgcagaggcgaagtgcgcggcgcccaggcctcccagcagcagtcccgagcagaggtaaccacccgcctcctcaaaaggactggccaaccaagcgcaccaggtgacacttcagtgaatggccctgtatgacgggtgacgtctgctgctgctgactgaggactgcagaccgccaccactcaggggctctggaggggtcagctggagcccaccaagctgtcactgctgcactcactctgcaagggatcaggaccagcaacctttatattctagattctaagacattgtacagagaaattcagaagtgtaaaaatattgcacattgacaaataccaagaatttttgcgtatgtttatattgtattgttctaaataatgggtagcctgtgaaataagatcttgccacccatgtaataatagtagtaatactatagttaaaatggctgtaagaatagttttataaaagtgaatacacagatctattgtatttgaaacataactttgacaattattagtgtgaccaaagtattaggcggttttcatacatttttcaccttgtacaaaattatgaattcatttttcctccaggccgacaaggagttgtagaatgaaaatgccctctaagtgttattttggttgttctaacttacaaaagtgattttgaataagaaatatttggtgttctttttataaccagtttttgattggtaattgttttctgtattgtttaaaacggatcaaaaatgtaagtctattggtagagattaagtaaagtatttattgctacatcatagttgataaattgatgttatcgtaaagccatatgttctgttcaagtcttgtttgcttgaaatgattattcctacaagtgaaacactagactatttggagtgtatatggcttgtgttttgggattttttttttttttttttggcttttgtttttgtttgtttttttgtttcatttggtagttcatctgccttttaacccattcaccaaaatttaccttgttaacaagcatcaccaatgaacatttcagagcaatctgcatatttaacagacctaaaataaatcctattaggcaagtcagttgaaaatgctcgtgctgctaatggaattagagtgcgttcattttacaggctagtattttaaaagtagaaatcaaaatctggcaccgaagcatgctaattgtttactgtaccttgtgaggttttcactcataaatttaaaccagtgtatttttttagaactggtttgtgtatatatatagtgattatggatactaattcaatgtaatttataattttctatgtcaatacaaaaatacatcacagccttctcaaacagctcaagcaatatattgtatattgccatatcgtctggtgaaagggttaaattacttcacctcttgcacttttagatgcaaatcagtttttcatttctgtaatagaaaattattcacgtatttttacatcatttgtttttcctgaccagtatttaaaaccaaaaggatattctgaaaaatggccaacaatttttttagaagtagcatcccaagcagcgtgcctaaacattacattgcatatggaaataaaagaatcaaacgtctaatgccttattatttctgatttcctttttcattttaagtggtgtggagattccagcactcccaggacagtggagtcagcagtaagccctgggacaggtggcaagggtgggtcccttgacctttgcacgcctcctcaggaaccccctttcccgggtgagcccctctctgaagagactgtccttgggcctcctctggaagcagcacccccagaggacagggctcctcctgcttgcctcagggctgcctgacttgaatggcgttggacctcggggattactggtagataatatgctctggtctcgcctggtggtgagttttgccagccatggccagggtttggctccactggtggcacacgtggcctccgtggtatggacctggtggcttctccatcccactgtggcctctgtggtatggacctggtggcttctccatcctacccaaggtaacagtgtcttgcttcatcccactgactgctgggagagagcctctgggacttttctttggggcatcattttgttttgtctttcgtagcagggaaaggatatgacaatggggaggacagttcttttggaggttggaggggccaagccaaggacaggagcaagtgtgccctcattttgtttctacttttaatttctgtgtgttggccatactgaattatgagactaacagatgtctacaatacaatacctgtattcaaaataacaaaaataaagcctgattctttgtttctagaaaaaaaaaaaaa

SEQ ID NO: 30 - DNA, 1199 bp, Homo sapiens
tgcgggcggcagggcagcggggcgatgaggtgaggacgcccgggaaccggaggcggcaccgcgcggcgcacggacctgggacgcggagtcctgaagccggcggacggttttcgtacgggcggccgtgcgcgaggcgaggtgaggcccctgtttctgttaggagagaacattgaaagtattctctaagctatttgaagagagtgactaaatgcacctgggtcaggctgtctgtgggtatgaagtggttgggagaatccaagaacatggtggtgaatggcaggagaaatggaggcaagttgtctaatgaccatcagcagaatcaatcaaaattacagcacacggggaaggacaccctgaaggctggcaaaaatgcagtcgagaggaggtcgaacagatgtatgtacacacttaaacctcttgcttttgcttttcacaggtaatggtaactcgggatttgaaggacagagtcgctatgtaccatcctctggaatgtccgccaaggaactctgtgaaaatgatgacctagcaaccagtttggttcttgatccctatttaggttttcaaacacacaaaatgaatactaggtaattttcagtctttatcctgttgtttgtttttgcatttatatagcgcctttccttcgaggagctcaaggcatttttcaaaatctgacagtttttctcacaacaaccctgtgaggtaggtagtgtgtgttaaaatcattcttttgatttctttcagatttaggcctattaaaggaaggcaggaagaactaaaggaagtaattgaacgttttaagaaagatgaacacttggagaaagccttcaaatgtttgacttcaggcgaatgggcacggcactattttctcaacaagaataaaatgcaggagaaattattcaaagaacatgtaagtttattaagactgatttttttttttcctgttttaggtatttatttatttgcgaatgtttgcaactgacagtggatttgaaatattgccatgtaatagatactcatcagaacaaaatggagccaaaatagttgcaacaaaagagtggtaactattctactagtataacacatcacatattttaaataggaaacgaaatgacaaaatagaattactggtgggttgtattgccgaactttcagaaattgaggagaacatgctacttagacatggagaaaacgacttcagt

SEQ ID NO: 31 - DNA, 7020 bp, Homo sapiens
tgcgggcggcagggcagcggggcgatgaggtgaggacgcccgggaaccggaggcggcaccgcgcggcgcacggacctgggacgcggagtcctgaagccggcggacggttttcgtacgggcggccgtgcgcgaggcgaggtgaggcccctgtttctgttaggagagaacattgaaagtattctctaagctatttgaagagagtgactaaatgcacctgggtcaggctgtctgtgggtatgaagtggttgggagaatccaagaacatggtggtgaatggcaggagaaatggaggcaagttgtctaatgaccatcagcagaatcaatcaaaattacagcacacggggaaggacaccctgaaggctggcaaaaatgcagtcgagaggaggtcgaacagatgtatgtacacacttaaacctcttgcttttgcttttcacaggtaatggtaactcgggatttgaaggacagagtcgctatgtaccatcctctggaatgtccgccaaggaactctgtgaaaatgatgacctagcaaccagtttggttcttgatccctatttaggttttcaaacacacaaaatgaatactaggtaattttcagtctttatcctgttgtttgtttttgcatttatatagcgcctttccttcgaggagctcaaggcatttttcaaaatctgacagtttttctcacaacaaccctgtgaggtaggtagtgtgtgttaaaatcattcttttgatttctttcagatttaggcctattaaaggaaggcaggaagaactaaaggaagtaattgaacgttttaagaaagatgaacacttggagaaagccttcaaatgtttgacttcaggcgaatgggcacggcactattttctcaacaagaataaaatgcaggagaaattattcaaagaacatgtaagtttattaagactgatttttttttttcctgttttaggtatttatttatttgcgaatgtttgcaactgacagtggatttgaaatattgccatgtaatagatactcatcagaacaaaatggagccaaaatagttgcaacaaaagagtggtaactattctactagtataacacatcacatattttaaataggaaacgaaatgacaaaatagaattactggtgggttgtattgccgaactttcagaaattgaggagaacatgctacttagacatggagaaaacgacttcagtgtcatgtactccacaaggaaaaactgtgctcaactctggctgggtcctgctgcgtttataaaccatggtaagctgtgtttccaaggtatcttttggacatttttcagattgcagacctaattgtaaggtaagcattaaaaaaatttttactgagttacttttattttagtttgtgtcaactggtcgagatacagcatgtgtgaaggctctaagagacattgaacctggagaagaaatttcttgttattatggagatgggttctttggagaaaataatgagttctgcgagtgttacacttgcgaaaggtaaggtattaagtaaaatgcctgtgctattttctctttcagacggggcactggtgcttttaaatccagagtgggactgcctgcgcctgctcctgttatcaatagcaaatatggactcagagaaacagataaacgtttaaataggcttaaaaagttaggtgacagcagcaaaaattcagacagtcaatctgtcagctctaacactgatgcagataccactcaggaaaaaaacaatgcaagtaagtaagggagatttgattttaaccttacagcttctaaccgaaaatcttcagttggcgtaaaaaagaatagcaagagcagaacgttaacgaggcaatctatgtcaagaattccagcttcttccaactctacctcatctaagctaactcatataaataattccagggtaccaaagaaactgaagaagcctgcaaagcctttactttcaaagataaaattgagaaatcattgcaagcggctggagcaaaagaatgcttcaagaaaactcgaaatgggaaacttagtactgaaagagcctaaagtagttctgtataaaaatttgcccattaaaaaagataaggagccagagggaccagcccaagccgcagttgccagcgggtgcttgactagacacgcggcgagagaacacagacagaatcctgtgagaggtgctcattcgcagggggagagctcgccctgcacctacataactcggcggtcagtgaggacaagaacaaatctgaaggaggcctctgacatcaagcttgaaccaaatacgttgaatggctataaaagcagtgtgacggaaccttgccccgacagtggtgaacagctgcagccagctcctgtgctgcaggaggaagaactggctcatgagactgcacaaaaaggggaggcaaagtgtcataagagtgacacaggcatgtccaaaaagaagtcacgacaaggaaaacttgtgaaacagtttgcaaaaatagaggaatctactccagtgcacgattctcctggaaaagacgacgcggtaccagatttgatgggtccccattctgaccagggtgagcacagtggcactgtgggcgtgcctgtgagctacacagactgtgctccttcacccgtcggttgttcagttgtgacatcagatagcttcaaaacaaaagacagctttagaactgcaaaaagtaaaaagaagaggcgaatcacaaggtatgatgcacagttaatcctagaaaataactctgggattcccaaattgactcttcgtaggcgtcatgatagcagcagcaaaacaaatgaccaagagaatgatggaatgaactcttccaaaataagcatcaagttaagcaaagaccatgacaacgataacaatctctatgtagcaaagcttaataatggatttaactcaggatcaggcagtagttctacaaaattaaaaatccagctaaaacgagatgaggaaaatagggggtcttatacagaggggcttcatgaaaatggggtgtgctgcagtgatcctctttctctcttggagtctcgaatggaggtggatgactatagtcagtatgaggaagaaagtacagatgattcctcctcttctgagggcgatgaagaggaggatgactatgatgatgactttgaagacgattttattcctcttcctccagctaagcgcttgaggttaatagttggaaaagactctatagatattgacatttcttcaaggagaagagaagatcagtctttaaggcttaatgcctaagctcttggtcttaacttgacctgggataactactttaaagaaataaaaaattccagtcaattattcctcaactgaaagtttagtggcagcacttctattgtcccttcacttatcagcatactattgtagaaagtgtacagcatactgactcaattcttaagtctgatttgtgcaaatttttatcgtactttttaaatagccttcttacgtgcaattctgagttagaggtaaagccctgttgtaaaataaaggctcaagcaaaattgtacagtgatagcaactttccacacaggacgttgaaaacagtaatgtggctacacagtttttttaactgtaagagcatcagctggctctttaatatatgactaaacaataatttaaaacaaatcatagtagcagcatattaagggtttctagtatgctaatatcaccagcaatgatctttggctttttgatttatttgctagatgtttcccccttggagttttgtcagtttcacactgtttgctggcccaggtgtactgtttgtggcctttgttaatatcgcaaaccattggttgggagtcagattggtttcttaaaaaaaaaaaaaaaacgacatacgtgacagctcacttttcagttcatgatatgtacgagggtagcagtgtgtgggatgaggttcgatacagcgtatttattgcttgtcatgtaaattaaaaaccttgtatttaactcttttcaatccttttagataaaattgttctttgcaagaatgattggtgcttattttttcaaaaatttgctgtgaacaacgtgatgacaacaagcaacatttatctaatgaactacagctatcttaatttggttcttcaagttttctgttgcacttgtaaaatgctacaaggaatattaaaaaaatctattcactttaacttataatagtttatgaaataaaaacatgagtcacagcttttgttctgtggtaacctataaaaaaagtttgtctttgagattcaatgtaaagaactgaaaacaatgtatatgttgtaaatatttgtgtgttgtgagaaatttttgtcataagaaattaaaagaacttaccaggaaggtttttaagtttagaaatattcatgccaataaaataggaaattataaatatatagttttaagcactgcatcagtgggagttcttggcttatgttagtttatgttagtttattatgaaaacatcaaagatttttttgactatattatcagttaaacaaaaaggagtcagatttaatttgttttttgaagcactttgagaaattaattttaattaacttaatgagcaaatttttattactactttatgttcaataccaggttcttttcatttctctggattattttgcaaatcattggacagagaatttgggaatataaatctgtaacaggtgtttgacaccagtaggtctctttatttctgggaaatgtgtacctgtactttctgatatacagtgttcctaagtaaaaatcaattcaggggatttgtatagtgtctataggaaagtagcccatgtcttgaaatatgaaaaggaatctgaaggtcatgaaaagtccagtggagaaaatctcaatgcttactgttactactaattgattcctactagtttccaggtttggggggatattgtttcaatgacgctccttaagactgttgattgcccataggttccaaatagaaattaagactcatgaacatttttagaaagtagattgttttctcctggttctctaaggaactacttctgcagtcttacatagtctcatccttgtttgttgtggtgcagtcgaactcctcaggcgtttggaaagcatgtggtagaccttcttccacacccacccatacccccgttcactgcgtctggaggtcttcaacagtgaagtagggcagcccacacagcctctcaggagcacctgtccgaggcacccggagcactttgcagagcacgtccagccctcatggggtccctgcatagaaatgtgaacccctgccactgaggaagatgaaggtagaccctgtgtctggaggtgctggagggcagcgggtcacctcttgtattcccaccttagtttggggtgttttgaagaggttcagagactaaatcttaaaccttatttgaataccaacgatagctattttgggaatttcgatcttaaaaagtgacaaaacacatttcccattttcatttttcagctgaattttagtaacttatttttgatgttttaattttatcatggcctcctctttggaggccaaccttcccatgggtctcaaagcagtgacatttggtagtaaatcactgcctctcaggagtcggtatgcacaagcactcagcagccactgttgatgccttctagggaaacctaatttccgttggtaaaggtaggggcctcggaactgttccggatctgctgtagaacttcaccgtgtggaatggtgacagccacacaccgttgaccagtttagaagaggttgcattcaataaaactcttagcttgagcttatgcaatgattggttaagattttggcattgtaagaattaggagatgatcatagaaatatatgtaaagtattcaattttcaatcattttcaaattactgttataaattgtttttgctgagttgtaatacttttgagatacaatgtattccttgtactgaaagaatgaaaaaggactttttcagcatttgaggtaagttctttaacgtttcattaaaaacattttttacaaatattttgtacatgcacttgcagtattgaggttaatcattttaataaattcggaaattaaaacaatttggccggtgttcactgtatctgaaaagaaaaaaaaaagatcaaagtggtgactttctccacaaaattttcatgtaaaacaatttgtaaaatcaatttctaaagcttttcaatacctgtgagtgttgagttctctgggccctggtctcttgtgtctggtgccactcatttttaagagaagagagggtaaacatacattcttcttttagtagggagactaaactacataccttcctagtccttgaacccaagaaatgtttgccctcaacatggagcacaataacatcgaaggcttttgcaacccaaatgcattaatagttcctgattacttggagttgtttttttcccccctctccgtattggtcaaagttagcatactcatgactggcctgggtccttttttcacccatttactgttgaaatatgactgtacaggagagaggaaacctgcaacatctgagtatccctgagcaagctgcttaatctccacatctctttcctggcacccagcatcattctgtgccggagatcagtgtggacgcctggtcccgtcatcagttaagtttctggttgagctgcattcactcatgaggataatctgggtgagtgctgcacacacgggactagtcaagtattgattattgatttttcctaattgattgaagtatccacccaaacttgggttcccagtatagaaaaaggctaagcgtggcatgtctgttaagtacttaggagtcttgttcagcatctcaggttttctctctactcttccaatagccaatggtagctaacttgccgggagcccttgtgtgactcgtttctcaaatgtcaactttctgtcactgacctgctgcaccgttgcgtactctgctgcagaacccagtcgcacccagagcagagtacaagcaagttgccagctccagggcactccctg

SEQ ID NO: 32 - DNA, 843 bp, Homo sapiens
ggccgaggctgcgggaagatggcggcggccatggcagcatcttccctgacggtcaccttagggcggctggcgtccgcgtgcagccacagcatcctgagaccttcggggcccggagcaggtgagacctgcttccctcagcctccctttggtctgcttctcgaaggttcaattcacagagcacttcatatctaccagggtaatatcaaaaatgtgttttacagatatgttcctaaaacatccctgagttcaccaccttggccagaagttgttctgccagacccagttgaggagaccagacaccatgcaggtaagacctccctgttcccctgcagaggtcgtgaagaaggtgaatgagatgatcgtcacggggcagtatggcaggctctttgccgtggtgcactttgccagccgccagtggaaggtgacctctgaagacctgatcttaattggaaatgaactagaccttgcgtgtggagagagaattcgactggagaaggtgagaccaccttgaatttttcaggtcctgctggttggggcagacaacttcacgctgcttggcaagccactcctcgggtaatggctgtgatcttccttctagaaaggatcttgttcgagtagaagccacagtcattgaaaagacagaatcatggccaagaatcattatgagattcaggaaaaggaaaaacttcaagaagaaaagaagtaagttagagcctttctttcagtcgtcacgaccccgcagactgtcctccggataaacagcattgagattgctccgtgtttgttgtgattaccgagttaatacttacaaaaggataaaaataaactcctgcttcccaagga

SEQ ID NO: 33 - DNA, 5985 bp, Homo sapiens
ccgtgcgcgcgtcagcaagaacgccagggacggggtctccgcgcctgcgcagtgaagctgggcgccttcggggcttgagcttctgagggtcgggtccagcgcgtgggctgctggatggcggaaccccaggcggagtcggagcccctgctgggcggggcccgcggcggtggcggcgactggccggcggggctgaccacttaccgcagcatccaagtcggccctggtgagccgccctgtcccctctgcctgcaggtgccgcggccaggtgggacctctgcattgatcaggctgtggtcttcatcgaagatgctattcaggtcggtggcacctgctccctgtggccgacttttcgcttgtagtaccgctccatcaaccaccgggtggatgccagctcgatgtggctttaccgacggtattactcgaacgtatgccaacggtgagaacgcacccattctgtcccctttccaggactttgagcttcaccatcttcttgatcctgtttttggcttttatcgagaccccatcctcactcaccagcacggcggacgtgcgctaccgcgctgccccctgggagccgccctgcggcctgaccgagagtgtcgaggtgctctgcctgctggtctttgcggccgacctctctgtgaaggtgaggcgggctcacccgcccgtctctcttgcagggttacctgttcgggtgggcccatttccagaaaaacctttggctgctgggctacctcgtggtgctggtggtgtctctggtggactggaccgtgtccctgagtctcgtgtgtcatgaggtaggtggtgaggcgggtctcttccagcccctgcggatccgccggcttctccgtcccttcttcctgctgcagaactcctctatgatgaagaagaccttgaaatgcatccgctggtcgctgccggaaatggccaggtgggctcttggttgctctcccccagcgtcgggctgctgctggccatccacctgtgcctcttcaccatgttcggaatgctgctgttcgctggtgggaaggtagggcacccgtgggcttctgctctcagcaggatgatgggcaggacagggagaggctgacctacttccagaacctgcctgagtctctgacttccctcctggtgctgctgaccacggccaacaaccccgatggtgcgtgcagggccacttttttcttttaggtgatgattcctgcgtattccaagaaccgggcctatgccatcttcttcatagtcttcactgtgataggtgagtgcaggtaacgttctcctcttgaaggaagcctgtttctgatgaacctgctgacagccatcatctacagtcagttccggggctacctgatggtgagcgagctccccaaccttcctctttgcagaaatctctccagacctcgctgtttcggaggcggctgggaacccgggctgcctttgaagtcctatcctccatggtgggggagggaggagccttccctcaggcgtgagtgctgggcattttccctgcagagttggggtgaagccccagaacttgctgcaggtgcttcagaaggtccagctggacagctcccacagacaggccatgatggaggtacccgcccccccttcctgtgcagaaggtgcgttcctatggcagtgttctgctctcagctgaggagtttcagaagctcttcaacgagcttgacagaagtgtggttaaagaggtaactggggccacgttccttgcccagcacccgccgaggcccgagtaccagtctccgtttctgcagagcgcccagttcctcttcggccactactactttgactacctggggaacctcatcgccctggcaaacctggtgtccatttgcgtgagtgtggatttgcctggcgttgcaggtgttcctggtgctggatgcagatgtgctgcctgctgagcgtgatgacttcatcctgggggtaagttctgagcctgcccctttcagattctcaactgcgtcttcattgtgtactacctgttggagatgctgctcaaggtctttgccctgggcctgcgagggtacctgtcctaccccagcaacgtgtttgacgggctcctcaccgttgtcctgctggtaaagtaggcgcacccgtgtctctccccaggaggccggagatggtgggcctgctgtcgctgtgggacatgacccgcatgctgaacatgctcatcgtgttccgcttcctgcgtatcatccccagcatgaaggtgtgtgccggccccactgtcctcagccgatggccgtggtggccagtaccgtcctgggcctggtgcagaacatgcgtgcgtttggcgggatcctggtggtgagtcccaggctgctgtcctggcccgccaggtggtctactacgtatttgccatcattgggatcaacttgtttagaggcgtcattgtggctcttcctggaaacagcaggtgaggtggggtccttgtgttccccagcctggcccctgccaatggctcggcgccctgtgggagcttcgagcagctggagtactgggccaacaacttcgatgactttgcggtgagccctgcgccctctgcccccgcaggctgccctggtcactctgtggaacttgatggtggtgaacaactggcaggtgtttctggatgcatatcggcgctactcaggcccgtgagtcctcgtctccctgatgtcctccgcaggtggtccaagatctattttgtattgtggtggctggtgtcgtctgtcatctgggtcaacctgtttctggccctgattctggaggtatcagcgctcctcctgcttgccagaacttccttcacaagtgggacccccgcagccacctgcagccccttgctgggaccccagaggccacctaccagatgactgtggagctcctgttcaggtgtgtgggtggggacctcaattccacagggatattctggaggagcccggggaggatgagctcacagagaggctgagccagcacccgcacctgtggctgtgcaggtgacgtccgggctgccgtcccagcaggggcggcaggagagagaggctggcctacacaggtgcccatcatggaagaggcggccatgctgtggccagccaggcaggaagagacctttcctctgacggaccactaagctggggacaggaaccaagtcctttgcgtgtggcccaacaaccatctacagaacagctgctggtgcttcagggaggcgccgtgccctccgctttcttttatagctgcttcagtgagaattccctcgtcgactccacagggacctttcagacaaaaatgcaagaagcagcggcctcccctgtcccctgcagcttccgtggtgcctttgctgccggcagcccttggggaccacaggcctgaccagggcctgcacaggttaaccgtcagacttccggggcattcaggtggggatgctggtggtttgacatggagagaaccttgactgtgttttattatttcatggcttgtatgagtgtgactgggtgtgtttctttagggttctgattgccagttattttcatcagtaagtcttgcaaagaatgggattgtcattcttcacttcagcacagttctagtcctgcttctctggagtagggttgttgagtaaggttgcttgggttgtgcattgcacaagggcacatggctgtgaggtgtatcctggcggggggctgtctacctgcagtgaggggcaccttttctgttttgctcaaaggcatgtataagccaatgggtgaccttatttcctgtgtcttcaggtgtgtggcagggggcctggggtggggaggtggggcgagcgagcagtgtgtggaaagccttgttgtcacctgaagcacgccaggtccagattgaccaatggttttctcacttcaggggccaacccacgccccctttctgctgaggtttgggtgccatctagtggtgggatgggacttggttgactacatttaaggtaaggtggacccagcaactcccagaaacaactccggggacaccactccccatcacactccacaccgagcctggtgcccggtctgtgcccgagctcagcgggaccaggaagggatgggccctgccagggttgcccctgcactgtgcattctcgcctgggaggcacaagttctttcatctgcttttccttcagaggtgctgagcccacgccatagcccctgggtgggggagggggcgacccgaacaacagtgcagtcggtatcgagattggggagaggagcgagtccaaggagaaagtcatgagtttctttttactcgtgttgaataataacaataacaataacaataacaatatggaaaccaccgcaaacttggagaaaagttgtaagcacagtaaagagaagcttccttctgagtcagttgagtggttgccgttctggccctgcaccctctgtgctttgggacggcgtccaacccgcattcatgtcaggagtgagtcgcacgtggctttgtggtcatggcgacttaatccgcctggacggtggctccgtctccctgggcttagacgaccttggcacttctggagataagcccatggctcccaggttgtgttcatgtgacgtttccttgtggtaggttctgggtctgcgttttgtctaggagtgtcacaggatggacactgcctcctggcaggggctgcccaatgcagttagcctcctgctggtgttctctcttgttgcttggtgaaggtggccctggtcagcttctccactgcccagtgaacgacccctttgtaatgaatgagtggggaggtagtgtgaagcgatgccaatatcccatccctgtcaaactgcctttactttttccttccttccttgctcccacctgtgtggatcctggtcccttcttgtattcagggctgtggtctgttatgacatttactctcaggctcaggtcctgcttgtttggcccgtgggagccccttcttctgccttttgtgttttttttgttatgtacctacagttctttagctgtttctttactttctggtgcaaaaagatgttcaagccttattttatacttgcctgcccctttctctttcatttattggagtgagctgcagctctaagaagacctgttcttttgaatggagagtagcatcaggaaccaggatgtgggtgcgaggcgtgctcctggctgttgcagattgctgcacccgggagctcttagtggacagagctagaggatatgtgcacgtacttccatctctctctctgtctcatctattcacagctgggaatgatactaatacctccgattttagcccagcaccacagggtacgttccagtttttctctctttccatagctgtaaggccctttctgggaatggttctcattctccttaatctattattgggtcagttttcctgcatgtccccagcctcccatcactgccacccactccccacagagatgccctgctcatccgactggggctttgactcccacactgtgtacccctcttgtgtggacgccctgctgccaaaaccttcagcaaacagctttccaaatggaagttgtcactgtcagggcctttacaatcagcaacagcaaaatctacatgctgctgagggtcctgcctcattaagatgcaataaatatgtaagtacataaaaacagcaatagaagaaacgtaatgcttttttctcaaatatgatgtctacatagaaaagccaaaattattaagaatagtaagaattcacccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccagcctgggcgacagagcgagactccgtctcaaaaaaaa

SEQ ID NO: 34 - DNA, 6076 bp, Homo sapiens
ccgtgcgcgcgtcagcaagaacgccagggacggggtctccgcgcctgcgcagtgaagctgggcgccttcggggcttgagcttctgagggtcgggtccagcgcgtgggctgctggatggcggaaccccaggcggagtcggagcccctgctgggcggggcccgcggcggtggcggcgactggccggcggggctgaccacttaccgcagcatccaagtcggccctggtgagccgccctgtcccctctgcctgcaggtgccgcggccaggtgggacctctgcattgatcaggctgtggtcttcatcgaagatgctattcaggtcggtggcacctgctccctgtggccgacttttcgcttgtagtaccgctccatcaaccaccgggtggatgccagctcgatgtggctttaccgacggtattactcgaacgtatgccaacggtgagaacgcacccattctgtcccctttccaggactttgagcttcaccatcttcttgatcctgtttttggcttttatcgagaccccatcctcactcaccagcacggcggacgtgcgctaccgcgctgccccctgggagccgccctgcggcctgaccgagagtgtcgaggtgctctgcctgctggtctttgcggccgacctctctgtgaaggtgaggcgggctcacccgcccgtctctcttgcagggttacctgttcgggtgggcccatttccagaaaaacctttggctgctgggctacctcgtggtgctggtggtgtctctggtggactggaccgtgtccctgagtctcgtgtgtcatgaggtaggtggtgaggcgggtctcttccagcccctgcggatccgccggcttctccgtcccttcttcctgctgcagaactcctctatgatgaagaagaccttgaaatgcatccgctggtcgctgccggaaatggccaggtgggctcttggttgctctcccccagcgtcgggctgctgctggccatccacctgtgcctcttcaccatgttcggaatgctgctgttcgctggtgggaaggtagggcacccgtgggcttctgctctcagcaggatgatgggcaggacagggagaggctgacctacttccagaacctgcctgagtctctgacttccctcctggtgctgctgaccacggccaacaaccccgatggtgcgtgcagggccacttttttcttttaggtgatgattcctgcgtattccaagaaccgggcctatgccatcttcttcatagtcttcactgtgataggtgagtgcaggtaacgttctcctcttgaaggaagcctgtttctgatgaacctgctgacagccatcatctacagtcagttccggggctacctgatggtgagcgagctccccaaccttcctctttgcagaaatctctccagacctcgctgtttcggaggcggctgggaacccgggctgcctttgaagtcctatcctccatggtgggggagggaggagccttccctcaggcgtgagtgctgggcattttccctgcagagttggggtgaagccccagaacttgctgcaggtgcttcagaaggtccagctggacagctcccacagacaggccatgatggaggtacccgcccccccttcctgtgcagaaggtgcgttcctatggcagtgttctgctctcagctgaggagtttcagaagctcttcaacgagcttgacagaagtgtggttaaagaggtaactggggccacgttccttgcccagcacccgccgaggcccgagtaccagtctccgtttctgcagagcgcccagttcctcttcggccactactactttgactacctggggaacctcatcgccctggcaaacctggtgtccatttgcgtgagtgtggatttgcctggcgttgcaggtgttcctggtgctggatgcagatgtgctgcctgctgagcgtgatgacttcatcctgggggtaagttctgagcctgcccctttcagattctcaactgcgtcttcattgtgtactacctgttggagatgctgctcaaggtctttgccctgggcctgcgagggtacctgtcctaccccagcaacgtgtttgacgggctcctcaccgttgtcctgctggtaaagtaggcgcattcttttcttttgtaattaaaggttttggagatctcaactctggctgtgtaccgattgccacacccaggctggtatgtgactgggcagaaccccgtgtctctccccaggaggccggagatggtgggcctgctgtcgctgtgggacatgacccgcatgctgaacatgctcatcgtgttccgcttcctgcgtatcatccccagcatgaaggtgtgtgccggccccactgtcctcagccgatggccgtggtggccagtaccgtcctgggcctggtgcagaacatgcgtgcgtttggcgggatcctggtggtgagtcccaggctgctgtcctggcccgccaggtggtctactacgtatttgccatcattgggatcaacttgtttagaggcgtcattgtggctcttcctggaaacagcaggtgaggtggggtccttgtgttccccagcctggcccctgccaatggctcggcgccctgtgggagcttcgagcagctggagtactgggccaacaacttcgatgactttgcggtgagccctgcgccctctgcccccgcaggctgccctggtcactctgtggaacttgatggtggtgaacaactggcaggtgtttctggatgcatatcggcgctactcaggcccgtgagtcctcgtctccctgatgtcctccgcaggtggtccaagatctattttgtattgtggtggctggtgtcgtctgtcatctgggtcaacctgtttctggccctgattctggaggtatcagcgctcctcctgcttgccagaacttccttcacaagtgggacccccgcagccacctgcagccccttgctgggaccccagaggccacctaccagatgactgtggagctcctgttcaggtgtgtgggtggggacctcaattccacagggatattctggaggagcccggggaggatgagctcacagagaggctgagccagcacccgcacctgtggctgtgcaggtgacgtccgggctgccgtcccagcaggggcggcaggagagagaggctggcctacacaggtgcccatcatggaagaggcggccatgctgtggccagccaggcaggaagagacctttcctctgacggaccactaagctggggacaggaaccaagtcctttgcgtgtggcccaacaaccatctacagaacagctgctggtgcttcagggaggcgccgtgccctccgctttcttttatagctgcttcagtgagaattccctcgtcgactccacagggacctttcagacaaaaatgcaagaagcagcggcctcccctgtcccctgcagcttccgtggtgcctttgctgccggcagcccttggggaccacaggcctgaccagggcctgcacaggttaaccgtcagacttccggggcattcaggtggggatgctggtggtttgacatggagagaaccttgactgtgttttattatttcatggcttgtatgagtgtgactgggtgtgtttctttagggttctgattgccagttattttcatcagtaagtcttgcaaagaatgggattgtcattcttcacttcagcacagttctagtcctgcttctctggagtagggttgttgagtaaggttgcttgggttgtgcattgcacaagggcacatggctgtgaggtgtatcctggcggggggctgtctacctgcagtgaggggcaccttttctgttttgctcaaaggcatgtataagccaatgggtgaccttatttcctgtgtcttcaggtgtgtggcagggggcctggggtggggaggtggggcgagcgagcagtgtgtggaaagccttgttgtcacctgaagcacgccaggtccagattgaccaatggttttctcacttcaggggccaacccacgccccctttctgctgaggtttgggtgccatctagtggtgggatgggacttggttgactacatttaaggtaaggtggacccagcaactcccagaaacaactccggggacaccactccccatcacactccacaccgagcctggtgcccggtctgtgcccgagctcagcgggaccaggaagggatgggccctgccagggttgcccctgcactgtgcattctcgcctgggaggcacaagttctttcatctgcttttccttcagaggtgctgagcccacgccatagcccctgggtgggggagggggcgacccgaacaacagtgcagtcggtatcgagattggggagaggagcgagtccaaggagaaagtcatgagtttctttttactcgtgttgaataataacaataacaataacaataacaatatggaaaccaccgcaaacttggagaaaagttgtaagcacagtaaagagaagcttccttctgagtcagttgagtggttgccgttctggccctgcaccctctgtgctttgggacggcgtccaacccgcattcatgtcaggagtgagtcgcacgtggctttgtggtcatggcgacttaatccgcctggacggtggctccgtctccctgggcttagacgaccttggcacttctggagataagcccatggctcccaggttgtgttcatgtgacgtttccttgtggtaggttctgggtctgcgttttgtctaggagtgtcacaggatggacactgcctcctggcaggggctgcccaatgcagttagcctcctgctggtgttctctcttgttgcttggtgaaggtggccctggtcagcttctccactgcccagtgaacgacccctttgtaatgaatgagtggggaggtagtgtgaagcgatgccaatatcccatccctgtcaaactgcctttactttttccttccttccttgctcccacctgtgtggatcctggtcccttcttgtattcagggctgtggtctgttatgacatttactctcaggctcaggtcctgcttgtttggcccgtgggagccccttcttctgccttttgtgttttttttgttatgtacctacagttctttagctgtttctttactttctggtgcaaaaagatgttcaagccttattttatacttgcctgcccctttctctttcatttattggagtgagctgcagctctaagaagacctgttcttttgaatggagagtagcatcaggaaccaggatgtgggtgcgaggcgtgctcctggctgttgcagattgctgcacccgggagctcttagtggacagagctagaggatatgtgcacgtacttccatctctctctctgtctcatctattcacagctgggaatgatactaatacctccgattttagcccagcaccacagggtacgttccagtttttctctctttccatagctgtaaggccctttctgggaatggttctcattctccttaatctattattgggtcagttttcctgcatgtccccagcctcccatcactgccacccactccccacagagatgccctgctcatccgactggggctttgactcccacactgtgtacccctcttgtgtggacgccctgctgccaaaaccttcagcaaacagctttccaaatggaagttgtcactgtcagggcctttacaatcagcaacagcaaaatctacatgctgctgagggtcctgcctcattaagatgcaataaatatgtaagtacataaaaacagcaatagaagaaacgtaatgcttttttctcaaatatgatgtctacatagaaaagccaaaattattaagaatagtaagaattcacccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccagcctgggcgacagagcgagactccgtctcaaaaaaaa

SEQ ID NO: 35 - DNA, 15 bp, Homo sapiens
gtcttcaccacgggg

SEQ ID NO: 36 - DNA, 11 bp, Homo sapiens
gtggtgaagac

SEQ ID NO: 37 - DNA, 18 bp, Homo sapiens
agcggaattcgtgagacc

SEQ ID NO: 38 - DNA, 23 bp, Homo sapiens
ttggtctcacgtattccgctcga

SEQ ID NO: 39 - DNA, 20 bp, Homo sapiens
ctcgagaattctggatcctc

SEQ ID NO: 40 - DNA, 22 bp, Homo sapiens
ttgaggatccagaattctcgag

SEQ ID NO: 41 - DNA, 21 bp, Homo sapiens
tgtatgcgaattcgctgcgcg

SEQ ID NO: 42 - DNA, 23 bp, Homo sapiens
ttcgcgcagcgaattcgcataca

SEQ ID NO: 43 - DNA, 21 bp, Homo sapiens
gtccactgaattctcagtgag

SEQ ID NO: 44 - DNA, 23 bp, Homo sapiens
ttgtcactgagaattcagtggac

SEQ ID NO: 45 - DNA, 21 bp, Homo sapiens
gaatccgaattcctggtcagc

SEQ ID NO: 46 - DNA, 23 bp, Homo sapiens
ttgctgaccaggaattcggattc

SEQ ID NO: 47 - DNA, 33 bp, Homo sapiens
cuacuacuacuactgagcggaattcgtgagacc

SEQ ID NO: 48 - DNA, 32 bp, Homo sapiens
cuacuacuacuactcgagaattctggatcctc

SEQ ID NO: 49 - DNA, 33 bp, Homo sapiens
cuacuacuacuatgtatgcgaattcgctgcgcg

SEQ ID NO: 50 - DNA, 33 bp, Homo sapiens
cuacuacuacuagtccactgaattctcagtgag

SEQ ID NO: 51 - DNA, 33 bp, Homo sapiens
cuacuacuacuagaatccgaattcctggtcagc

SEQ ID NO: 52 - DNA, 45 bp, Homo sapiens
aactggaagaattcgcggccgcaggaatttttttttttttttttt

SEQ ID NO: 53 - DNA, 13 bp, Homo sapiens
aattcggcacgag

SEQ ID NO: 54 - DNA, 9 bp, Homo sapiens
ctcgtgccg

SEQ ID NO: 55 - DNA, 14 bp, Homo sapiens
gtacgacggccagt

SEQ ID NO: 56 - DNA, 16 bp, Homo sapiens
aacagctatgaccatg

SEQ ID NO: 57 - DNA, 20 bp, Homo sapiens
gagaggctatatccctgggc

SEQ ID NO: 58 - DNA, 20 bp, Homo sapiens
acagcacgtgtttaaagggg

The invention claimed is:

1. An isolated amino acid sequence comprising SEQ ID NO: 14.

2. An isolated amino acid sequence encoded by a nucleic acid sequence comprising SEQ ID NO:6.

3. An isolated fragment of an amino acid sequence comprising at least 20 or more consecutive residues of SEQ ID NO: 14.

* * * * *